US008470310B2

(12) United States Patent
Roy et al.

(10) Patent No.: US 8,470,310 B2
(45) Date of Patent: Jun. 25, 2013

(54) SIMIAN ADENOVIRUSES SADV-36, -42.1, -42.2, AND -44 AND USES THEREOF

(75) Inventors: Soumitra Roy, Liederdorp (NL); James M. Wilson, Glen Mills, PA (US); Luc H. Vandenberghe, Philadelphia, PA (US)

(73) Assignee: The Trustees of the University of Pennsylvania, Philadelphia, PA (US)

( * ) Notice: Subject to any disclaimer, the term of this patent is extended or adjusted under 35 U.S.C. 154(b) by 128 days.

(21) Appl. No.: 12/920,648

(22) PCT Filed: Mar. 3, 2009

(86) PCT No.: PCT/US2009/001344
§ 371 (c)(1),
(2), (4) Date: Sep. 2, 2010

(87) PCT Pub. No.: WO2009/136977
PCT Pub. Date: Nov. 12, 2009

(65) Prior Publication Data
US 2011/0008295 A1    Jan. 13, 2011

Related U.S. Application Data

(60) Provisional application No. 61/067,993, filed on Mar. 4, 2008, provisional application No. 61/068,027, filed on Mar. 4, 2008, provisional application No. 61/068,024, filed on Mar. 4, 2008, provisional application No. 61/068,069, filed on Mar. 4, 2008.

(51) Int. Cl.
*A61K 35/76* (2006.01)
*C12N 7/00* (2006.01)

(52) U.S. Cl.
USPC ... 424/93.2; 424/93.6; 435/235.1; 435/320.1; 536/23.1

(58) Field of Classification Search
USPC ........................................ 424/93.2
See application file for complete search history.

(56) References Cited

U.S. PATENT DOCUMENTS

| 6,083,716 A | 7/2000 | Wilson et al. |
|---|---|---|
| 6,211,160 B1 | 4/2001 | Wilson et al. |
| 6,911,199 B2 | 6/2005 | Vigne et al. |
| 6,955,808 B2 | 10/2005 | Curiel |
| 7,247,472 B2 | 7/2007 | Wilson et al. |
| 7,291,498 B2 | 11/2007 | Roy et al. |
| 7,491,508 B2 | 2/2009 | Roy et al. |
| 8,231,880 B2 | 7/2012 | Roy et al. |
| 2008/0090281 A1 | 4/2008 | Wilson et al. |
| 2008/0161312 A1 | 7/2008 | Meijer et al. |
| 2009/0074810 A1 | 3/2009 | Roy et al. |
| 2009/0215871 A1 | 8/2009 | Wilson et al. |
| 2010/0247490 A1 | 9/2010 | Roy et al. |
| 2010/0254947 A1 | 10/2010 | Roy et al. |
| 2010/0260799 A1 | 10/2010 | Roy et al. |

FOREIGN PATENT DOCUMENTS

| EP | 2012822 | 1/2009 |
|---|---|---|
| WO | WO 98/09656 A1 | 3/1998 |
| WO | WO 03 000851 A | 1/2003 |
| WO | WO 2004/016614 A2 | 2/2004 |
| WO | WO 2005 001103 A | 1/2005 |
| WO | WO 2005/026337 A2 | 3/2005 |
| WO | WO 2005 071093 A2 | 8/2005 |
| WO | WO 2006/133911 A | 12/2006 |
| WO | WO 2008/010864 A2 | 1/2008 |
| WO | WO 2009/073104 A3 | 8/2009 |
| WO | WO 2009/105084 | 12/2009 |
| WO | WO 2010/051367 A1 | 5/2010 |

OTHER PUBLICATIONS

Roy et al., Generation of an adenoviral vaccine vector based on simian adenovirus 21, J Gen Virol. 87(Pt 9):2477-85, 2006.*
Collins English Dictionary—Complete and Unabridged 10th Edition 2009—Definition for "hybrid".*
Crompton et al, J Gen Virol, 1994, 75:133-139.*
Hong et al, J Virol, 1996, 70:7071-7078.*
Khare et al, Current Gene Therapy, 2011, 11:241-258.*
Vigne et al, J Virol, 1999, 73:5156-5161.*
Wu et al, J Virol, 2005, 79:3382-3390.*
Mercier et al, PNAS, 2004, 101:6188-6193.*
Crawford-Miksza, Analysis of 15 Adenovirus Hexon Proteins Reveals the Location and Structure of Seven Hypervariable Regions Containing Serotype-Specific Residues, Journal of Virology, 70:1836-1844, (Mar. 1996).
Crompton et al, Expression of a Foreign Epitope on the Surface of the Adenovirus Hexon, Journal of General Virology, 75:133-9, (Jan. 1994).
Curiel, D.T., Stratagies to Adapt Adenoviral Vectors for Targeted Delivery, Annuals New York Academy of Sciences, 886:158-71, (1999).
Dmitriev, I.P., Engineering of Adenovirus Vectors Containing Heterologous Peptide Sequences in the C Terminus of Capsid Protein IX, Journal of Virology, 76:6893-9, (Jul. 2002).
Einfeld, D.A. et al, Construction of a Pseudoreceptor that Mediates Transduction by Adenoviruses Expressing a Ligand in Fiber or Penton Base, Virology, 73:9130-6, (Nov. 1999).
Farina, Replication-defective vector based on a chimpanzee adenovirus, Journal of Virology, 75(23):11603-11613, (Dec. 1, 2001).
Roberts et al, Three-Dimensional Structure of the Adenovirus Major Coat Protein Hexon, Science, 232:1148-51, (May 1986).
Roy et al, Isolation and Characterisation of Adenoviruses Persistently Shed from the Gastrointestinal Tract of Non-human Primates, PLOS Pathogens, 5(7):1-9, (Jul. 2009).
Roy, Partial Protection against H5N1 Influenza in Mice with a Single Dose of a Chimpanzee Adenovirus Vector Expressing Nucleoprotein, Vaccine, 25(39-40):6845-6851, (Sep. 15, 2007).

(Continued)

*Primary Examiner* — Anoop Singh
*Assistant Examiner* — Chi-Feng Hsu
(74) *Attorney, Agent, or Firm* — Howson & Howson LLP

(57) ABSTRACT

A recombinant vector comprises simian adenovirus 36, simian adenovirus 42.1, simian adenovirus 42.2 and/or simian adenovirus 44 sequences and a heterologous gene under the control of regulatory sequences. A cell line which expresses one or more simian adenovirus-36, -42.1, -42.2 or -44 gene(s) is also described. Methods of using the vectors and cell lines are provided.

17 Claims, 1 Drawing Sheet

OTHER PUBLICATIONS

Roy, Complete Nucleotide Sequences and Genome Organization of Four Chimpanzee Adenoviruses, Virology, 324(2):361-372, (Jul. 1, 2004).

Roy, Characterization of a Family of Chimpanzee Adenoviruses and Development of Molecular Clones for Gene Transfer Vectors, Human Gene Therapy, 15(5):519-530, (May 1, 2004).

Roy, Rescue of Chimeric Adenoviral Vectors to Expand the Serotype Repertoire, Journal of Virological Methods, 141(1):14-21, (Feb. 21, 2007).

Roy, Generation of an Adenoviral Vaccine Vector Based on Simian Adenovirus 21, Journal of General Virology, 87(9):2477-2485, (Sep. 2006).

Russell, W.C., Update on Adenovirus and its Vectors, Journal of General Virology, 81 (pt11):2573-2604, (Nov. 2000).

Rux et al, Structural and Phylogenetic Analysis of Adenovirus Hexons by Use of High-Resolution X-Ray Crystallographic, Molecular Modeling, and Sequence-Based Methods, Journal of Virology, 77:9553-66, (Sep. 2003).

Shenk, T, Adenoviridae: The Viruses and Their Replication, Fields Virology, Chapter 67, Third Edition, Edited by B.N. Fields et al, Lippincott Raven Publishers, Philadelphia, pp. 111-2112, (1996).

Vigne, E. et al, RGD Inclusion in the Hexon Monomer Provides Adenovirus Type 5-Based Vectors with a Fiber Knob-Independent Pathway for Infection, Journal of Virology, 73:5156-61, (Jun. 1999).

Worgall et al, Protection Against P. Aeruginosa with an Adenovirus Vector Containing an OprF Epitope in the Capsid, The Journal of Clinical Investigation, 115(5):1281 (May 2005).

Wu et al, Identification of Sites in Adenovirus Hexon for Foreign Peptide Incorporation, Journal of Virology, 79(6):3382, (Mar. 2005).

International Search report corresponding to International Application No. PCT/US2009/001344 and the Written Opinion.

Office Action dated Oct. 2, 2012 in U.S. Appl. No. 12/744,375.

Nov. 14, 2012 Interview Summary in U.S. Appl. No. 12/744,375.

Office Action dated Oct. 4, 2012 in U.S. Appl. No. 12/744,441.

* cited by examiner

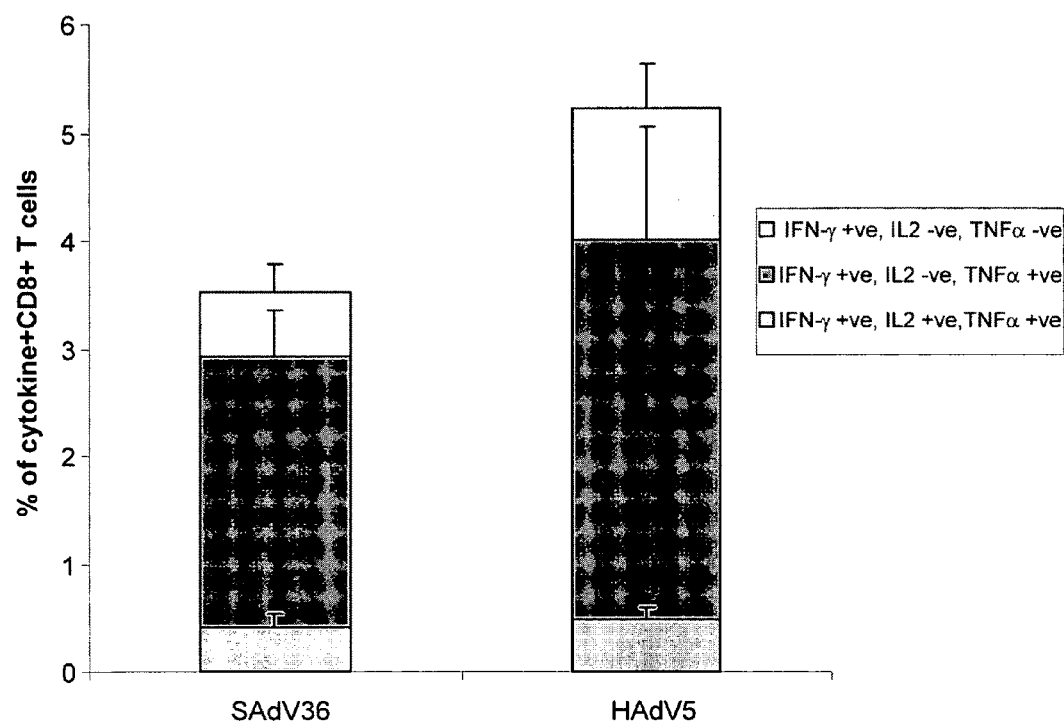

US 8,470,310 B2

SIMIAN ADENOVIRUSES SADV-36, -42.1, -42.2, AND -44 AND USES THEREOF

CROSS-REFERENCE TO RELATED APPLICATIONS

This is a national stage application under 35 U.S.C. 371 of PCT/US2009/001344, filed on Mar. 3, 2009 which claims the benefit under 35 USC 119(e) of U.S. Patent Application No. 61/067,993, 61/068,027, 61/068,024, and 61/068,069, all applications were filed on Mar. 4, 2008.

STATEMENT REGARDING FEDERALLY SPONSORED RESEARCH OR DEVELOPMENT

This work has been supported in part by a grant from the National Institutes of Health, NIH grant number P30-DK47757. The US government may have certain rights in this invention.

INCORPORATION-BY REFERENCE OF MATERIAL SUBMITTED ON A COMPACT DISK

Applicant hereby incorporates by reference the Sequence Listing material on the compact discs provided herewith. These compact discs are supplied in duplicate and contain only the "Sequence Listing" in computer readable form. These discs are labeled "Copy 1" and "Copy 2," respectively. The files on these discs are labeled "UPN-U4707PCTsequencelisting.txt".

BACKGROUND OF THE INVENTION

Adenovirus is a double-stranded DNA virus with a genome size of about 36 kilobases (kb), which has been widely used for gene transfer applications due to its ability to achieve highly efficient gene transfer in a variety of target tissues and large transgene capacity. Conventionally, E1 genes of adenovirus are deleted and replaced with a transgene cassette consisting of the promoter of choice, cDNA sequence of the gene of interest and a poly A signal, resulting in a replication defective recombinant virus.

Adenoviruses have a characteristic morphology with an icosahedral capsid consisting of three major proteins, hexon (II), penton base (III) and a knobbed fibre (IV), along with a number of other minor proteins, VI, VIII, IX, Ma and IVa2 [W. C. Russell, *J. Gen Virol.*, 81:2573-2604 (November 2000)]. The virus genome is a linear, double-stranded DNA with a terminal protein attached covalently to the 5' terminus, which have inverted terminal repeats (ITRs). The virus DNA is intimately associated with the highly basic protein VII and a small peptide pX (formerly termed mu). Another protein, V, is packaged with this DNA-protein complex and provides a structural link to the capsid via protein VI. The virus also contains a virus-encoded protease, which is necessary for processing of some of the structural proteins to produce mature infectious virus.

A classification scheme has been developed for the Mastadenovirus family, which includes human, simian, bovine, equine, porcine, ovine, canine and opossum adenoviruses. This classification scheme was developed based on the differing abilities of the adenovirus sequences in the family to agglutinate red blood cells. The result was six subgroups, now referred to as subgroups A, B, C, D, E and F. See, T. Shenk et al., *Adenoviridae: The Viruses and their Replication*", Ch. 67, in FIELD'S VIROLOGY, 6$^{th}$ Ed., edited by B. N Fields et al, (Lippincott Raven Publishers, Philadelphia, 1996), p. 111-2112.

Recombinant adenoviruses have been described for delivery of heterologous molecules to host cells. See, U.S. Pat. No. 6,083,716, which describes the genome of two chimpanzee adenoviruses. Simian adenoviruses, C5, C6 and C7, have been described in U.S. Pat. No. 7,247,472 as being useful as vaccine vectors. Other chimpanzee adenoviruses are described in WO 2005/071093 as being useful for making adenovirus vaccine carriers.

What is needed in the art are effective vectors which avoid the effect of pre-existing immunity to selected adenovirus serotypes in the population.

SUMMARY OF THE INVENTION

Isolated nucleic acid sequences and amino acid sequences of simian adenovirus 36 (SAdV-36), simian adenovirus 42.1 (SAdV-42.1), simian adenovirus 42.2 (SAdV-42.2), simian adenovirus 44 (SAdV-44), and vectors containing these sequences are provided herein. Also provided are a number of methods for using the vectors and cells of the invention.

The methods described herein involve delivering one or more selected heterologous gene(s) to a mammalian patient by administering a vector of the invention. Use of the compositions described herein for vaccination permits presentation of a selected antigen for the elicitation of protective immune responses. The vectors based on SAdV-36, SAdV-42.1, SAdV-42.2 and SAdV-44 may also be used for producing heterologous gene products in vitro. Such gene products are themselves useful in a variety for a variety of purposes such as are described herein.

These and other embodiments and advantages of the invention are described in more detail below.

BRIEF DESCRIPTION OF THE DRAWINGS

FIG. 1 illustrates the polyfunctionality of CD8+T cells in response to stimulation with a influenza nucleoprotein peptide following vaccination with C36 CMV PI FluA NP (a recombinant SAdV-36 virus harboring the NP expression cassette—see Example 4)) and AdH5-FluA NP (a recombinant HAdV-5 virus harboring the NP expression cassette), as described in Example 5. For both SAdV-36 and HAdV-5, the percentage of cytokine+CD8+T cells is shown. In each bar, the top segment reflects the subset of CD8+T cells secreting IFN-γ, but not IL2 or TNFa. The middle segment reflects the subset of CD8+T cells secreting IFN-γ and TNFa, but not IL2. The bottom segment reflects the subset of CD8+T cells secreting IFN-γ, IL2, and TNFa.

DETAILED DESCRIPTION OF THE INVENTION

Novel nucleic acid and amino acid sequences from simian adenovirus 36 (SAdV-36), SAdV-42.1, SAdV-42.2 and SAdV-44, which was isolated from simian feces, are provided. Also provided are novel adenovirus vectors and packaging cell lines to produce those vectors for use in the in vitro production of recombinant proteins or fragments or other reagents. Further provided are compositions for use in delivering a heterologous molecule for therapeutic or vaccine purposes. Such therapeutic or vaccine compositions contain the adenoviral vectors carrying an inserted heterologous molecule. In addition, the novel SAdV-36, SAdV-42.1, SAdV-42.2 and SAdV-44 sequences are useful in providing the essential helper functions required for production of recombinant adeno-associated viral (AAV) vectors. Thus, helper constructs, methods and cell lines which use these sequences in such production methods, are provided.

SAdV-36 has been determined by the inventors to be in the same subgroup as human subgroup E adenoviruses. Since this virus is from subgroup E, the capsid of this virus (optionally an intact or recombinant viral particle or an empty capsid) is useful in method of inducing an immunomodulatory effect or enhanced immune response by delivering an adenovirus subgroup E capsid to subject. The SAdV-36 capsid can be delivered alone or in a combination regimen with an active agent to enhance the immune response thereto. In another aspect, a method of inducing interferon alpha production in a subject in need thereof comprising delivering the SAdV-36 capsid to a subject is provided. In still another aspect, a method for producing one or more cytokines in culture is provided. This method involves incubating a culture containing dendritic cells and the SAdV-36 capsid under conditions suitable to produce cytokines/chemokines, including, among others, alpha interferon.

SAdV-42.1, 42.2 and 44 have been determined by the inventors to be within the same subgroup as human subgroup C adenoviruses. SAdV-42.1 and SAdV-42.2 were previously identified to be within the same phylogenic subgroup as human subgroup C adenoviruses. SAdV-42.1 and SAdV-42.2 were previously identified as SAdV-42 and SAdV-43 in U.S. Provisional Patent Application Nos. 61/068,069 (filed Mar. 4, 2008) and 61/067,993 (filed Mar. 4, 2008), respectively, from which priority is claimed. While these adenoviruses may not be serologically distinct, their revised nomenclature reflects that they are closely structurally related, differing by approximately six amino acids or fewer within their respective hexon regions.

The term "substantial homology" or "substantial similarity," when referring to a nucleic acid or fragment thereof, indicates that, when optimally aligned with appropriate nucleotide insertions or deletions with another nucleic acid (or its complementary strand), there is nucleotide sequence identity in at least about 95 to 99% of the aligned sequences.

The term "substantial homology" or "substantial similarity," when referring to amino acids or fragments thereof, indicates that, when optimally aligned with appropriate amino acid insertions or deletions with another amino acid (or its complementary strand), there is amino acid sequence identity in at least about 95 to 99% of the aligned sequences. Preferably, the homology is over full-length sequence, or a protein thereof, or a fragment thereof which is at least 8 amino acids, or more desirably, at least 15 amino acids in length. Examples of suitable fragments are described herein.

The term "percent sequence identity" or "identical" in the context of nucleic acid sequences refers to the residues in the two sequences that are the same when aligned for maximum correspondence. The length of sequence identity comparison may be over the full-length of the genome (e.g., about 36 kbp), the full-length of an open reading frame of a gene, protein, subunit, or enzyme [see, e.g., the tables providing the adenoviral coding regions], or a fragment of at least about 500 to 5000 nucleotides, is desired. However, identity among smaller fragments, e.g. of at least about nine nucleotides, usually at least about 20 to 24 nucleotides, at least about 28 to 32 nucleotides, at least about 36 or more nucleotides, may also be desired. Similarly, "percent sequence identity" may be readily determined for amino acid sequences, over the full-length of a protein, or a fragment thereof. Suitably, a fragment is at least about 8 amino acids in length, and may be up to about 700 amino acids. Examples of suitable fragments are described herein.

Identity is readily determined using such algorithms and computer programs as are defined herein at default settings. Preferably, such identity is over the full length of the protein, enzyme, subunit, or over a fragment of at least about 8 amino acids in length. However, identity may be based upon shorter regions, where suited to the use to which the identical gene product is being put.

As described herein, alignments are performed using any of a variety of publicly or commercially available Multiple Sequence Alignment Programs, such as "Clustal W", accessible through Web Servers on the internet. Alternatively, Vector NTI® utilities [InVitrogen] are also used. There are also a number of algorithms known in the art that can be used to measure nucleotide sequence identity, including those contained in the programs described above. As another example, polynucleotide sequences can be compared using Fasta, a program in GCG Version 6.1. Fasta provides alignments and percent sequence identity of the regions of the best overlap between the query and search sequences. For instance, percent sequence identity between nucleic acid sequences can be determined using Fasta with its default parameters (a word size of 6 and the NOPAM factor for the scoring matrix) as provided in GCG Version 6.1, herein incorporated by reference. Similarly programs are available for performing amino acid alignments. Generally, these programs are used at default settings, although one of skill in the art can alter these settings as needed. Alternatively, one of skill in the art can utilize another algorithm or computer program that provides at least the level of identity or alignment as that provided by the referenced algorithms and programs.

"Recombinant", as applied to a polynucleotide, means that the polynucleotide is the product of various combinations of cloning, restriction or ligation steps, and other procedures that result in a construct that is distinct from a polynucleotide found in nature. A recombinant virus is a viral particle comprising a recombinant polynucleotide. The terms respectively include replicates of the original polynucleotide construct and progeny of the original virus construct.

"Heterologous" means derived from a genotypically distinct entity from that of the rest of the entity to which it is being compared. For example, a polynucleotide introduced by genetic engineering techniques into a plasmid or vector derived from a different species is a heterologous polynucleotide. A promoter removed from its native coding sequence and operatively linked to a coding sequence with which it is not naturally found linked is a heterologous promoter. A site-specific recombination site that has been cloned into a genome of a virus or viral vector, wherein the genome of the virus does not naturally contain it, is a heterologous recombination site. When a polynucleotide with an encoding sequence for a recombinase is used to genetically alter a cell that does not normally express the recombinase, both the polynucleotide and the recombinase are heterologous to the cell.

As used throughout this specification and the claims, the term "comprise" and its variants including, "comprises", "comprising", among other variants, is inclusive of other components, elements, integers, steps and the like. The term "consists of" or "consisting of" are exclusive of other components, elements, integers, steps and the like.

I. The Simian Adenovirus Sequences

The invention provides nucleic acid sequences and amino acid sequences of simian adenovirus 36 (SAdV-36), SAdV-42.1, SAdV42.2, and SAdV-44, each of which are isolated from the other material with which they are associated in nature.

A. Nucleic Acid Sequences

The SAdV-36 nucleic acid sequences provided herein include nucleotides 1 to 36556 of SEQ ID NO:1. The SAdV-42.1 nucleic acid sequences provided herein include nucleotides 1 to 37786 of SEQ ID NO:33. The SAdV-42.2 nucleic acid sequences provided herein include nucleotides 1 to 37820 of SEQ ID NO:64. The SAdV-44 nucleic acid sequences provided herein include nucleotides 1 to 37711 of SEQ ID NO:95. See Sequence Listing, which is incorporated by reference herein.

In one embodiment, the nucleic acid sequences of the invention further encompass the strand which is complementary to the sequences of SEQ ID NO: 1, 33, 64 and 95, as well as the RNA and cDNA sequences corresponding to the sequences of the following sequences and their complementary strands. In another embodiment, the nucleic acid sequences further encompass sequences which are greater than 98.5% identical, and preferably, greater than about 99% identical, to the Sequence Listing. Also included in one embodiment, are natural variants and engineered modifications of the sequences provided in SEQ ID NO: 1, 33, 64 and 95, and their complementary strands. Such modifications include, for example, labels that are known in the art, methylation, and substitution of one or more of the naturally occurring nucleotides with a degenerate nucleotide.

TABLE 1

NUCLEIC ACID REGIONS

| Regions | | SAdV-36 ORF SEQ ID NO: 1 | SAdV-42.1 ORF SEQ ID NO: 33 | SAdV-42.2 ORF SEQ ID NO: 64 | SAdV-44 ORF SEQ ID NO: 95 |
|---|---|---|---|---|---|
| ITR | | 1 ... 124 | 1 ... 109 | 1 ... 119 | 1 ... 106 |
| E1a | | Join 576 ... 1143, 1228 ... 1433 | Join 566 ... 1106, 1217 ... 1512 | Join 576 ... 1116, 1229 ... 1524 | Join 576 ... 1116, 1226 ... 1521 |
| E1b | Small T/19K | 1598 ... 2173 | 1597 ... 2247 | 1609 ... 2259 | 1606 ... 2256 |
| | Large T/55K | 1903 ... 3414 | 1989 ... 3512 | 2001 ... 3524 | 1998 ... 3521 |
| | IX | 3502 ... 3927 | 3612 ... 4052 | 3624 ... 4064 | 3621 ... 4061 |
| E2b | pTP | Complement (8458 ... 10380, 13827 ... 13835) | Complement (8627 ... 10618, 14208 ... 14216) | Complement (8639 ... 10642, 14235 ... 14243) | Complement (8636 ... 10639, 14231 ... 14239) |
| | Polymerase | Complement (5096 ... 8656, 13827 ... 13835) | Complement (5223 ... 8825, 14208 ... 14216) | Complement (5235 ... 8837, 14235 ... 14243) | Complement (5232 ... 8834, 14231 ... 14239) |
| | IVa2 | Complement (3993 ... 5323, 5602 ... 5614) | Complement (4117 ... 5450, 5729 ... 5741) | Complement (4129 ... 5462, 5741 ... 5753) | Complement (4126 ... 5459, 5738 ... 5750) |
| L1 | 52/55D | 10815 ... 11996 | 11097 ... 12356 | 11117 ... 12376 | 11114 ... 12370 |
| | IIIa | 12023 ... 13798 | 12383 ... 14152 | 12403 ... 14172 | 12397 ... 14166 |
| L2 | Penton | 13880 ... 15502 | 14258 ... 16000 | 14285 ... 16042 | 14281 ... 16023 |
| | VII | 15509 ... 16093 | 16006 ... 16602 | 16048 ... 16644 | 16029 ... 16625 |
| | V | 16141 ... 17175 | 16696 ... 17817 | 16743 ... 17843 | 16724 ... 17815 |
| | pX | 17201 ... 17431 | 17845 ... 18084 | 17872 ... 18111 | 17844 ... 18083 |
| L3 | VI | 17507 ... 18229 | 18191 ... 18967 | 18219 ... 18995 | 18190 ... 18966 |
| | Hexon | 18324 ... 21146 | 19098 ... 21968 | 19126 ... 21196 | 19097 ... 21982 |
| | Endo-protease | 21173 ... 21793 | 22001 ... 22633 | 22029 ... 22661 | 22015 ... 22647 |
| E2a | DBP | Complement (21881 ... 23416) | Complement (22764 ... 24404) | Complement (22792 ... 24423) | Complement (22773 ... 24407) |
| L4 | 100 kD | 23439 ... 25841 | 24442 ... 26934 | 24461 ... 26950 | 24445 ... 26940 |
| | 33 kD | Join 25552 ... 25888, 26058 ... 26392 | Join 26633 ... 26973, 27293 ... 27569 | Join 26649 ... 26989, 27315 ... 27591 | Join 26639 ... 26969, 27187 ... 27575 |
| | homolog 22 kD | 25552 ... 26121 | 26633 ... 27253 | 26649 ... 27275 | 26639 ... 27259 |
| | VIII | 26467 ... 27147 | 27648 ... 28328 | 27670 ... 28350 | 27654 ... 28334 |
| E3 | 12.5K | 27151 ... 27468 | 28332 ... 28646 | 28354 ... 28668 | 28338 ... 28652 |
| | CR1-alpha | 27425 ... 28048 | 28603 ... 29157 | 28625 ... 29179 | 28657 ... 29163 |
| | gp19K | 28033 ... 28566 | 29344 ... 29820 | 29366 ... 29842 | 29350 ... 29826 |
| | CR1-beta | 28600 ... 29217 | 29852 ... 30751 | 29874 ... 30782 | 29858 ... 30766 |
| | CR1-gamma | 29233 ... 29844 | 30751 ... 31560 | 30782 ... 31588 | 30766 ... 31581 |
| | CR1-delta | 29862 ... 30743 | — | — | — |
| | RID-alpha | 30754 ... 31026 | 31575 ... 31844 | 31603 ... 31872 | 31596 ... 31865 |
| | RID-beta | 31035 ... 31466 | 31850 ... 32248 | 31878 ... 32276 | 31871 ... 32269 |
| | 14.7K | 31462 ... 31866 | 32244 ... 32627 | 32272 ... 32655 | 32265 ... 32648 |
| L5 | Fiber | 32167 ... 33441 | 32836 ... 34566 | 32810 ... 34594 | 32803 ... 34482 |
| E4 | Orf 6/7 | Complement (33557 ... 33808, 34540 ... 34710) | Complement (34755 ... 35027, 35730 ... 35912) | Complement (34782 ... 35054, 35757 ... 35939) | Complement (34672 ... 34944, 35647 ... 35829) |
| | Orf 6 | Complement (33808 ... 34710) | Complement (35031 ... 35912) | Complement (35058 ... 35939) | Complement (34948 ... 35829) |

TABLE 1-continued

| | NUCLEIC ACID REGIONS | | | |
|---|---|---|---|---|
| Regions | SAdV-36 ORF SEQ ID NO: 1 | SAdV-42.1 ORF SEQ ID NO: 33 | SAdV-42.2 ORF SEQ ID NO: 64 | SAdV-44 ORF SEQ ID NO: 95 |
| Orf 4 | Complement (34619 ... 34981) | Complement (35815 ... 36180) | Complement (35842 ... 36207) | Complement (35732 ... 36097) |
| Orf 3 | Complement (34994 ... 35344) | Complement (36190 ... 36534) | Complement (36217 ... 36561) | Complement (36107 ... 36451) |
| Orf 2 | Complement (35344 ... 35730) | Complement (36534 ... 36923) | Complement (36561 ... 36950) | Complement (36451 ... 36840) |
| Orf1 | Complement (35773 ... 36144) | Complement (36987 ... 37370) | Complement (37011 ... 37394) | Complement (36902 ... 37285) |
| ITR | Complement (36433 ... 36556) | Complement (37678 ... 37786) | Complement (37702 ... 37820) | Complement (37606 ... 37711) |

In one embodiment, fragments of the sequences of SAdV-36, SAdV-42.1, SAdV-42.2 and SAdV-44, and their complementary strand, cDNA and RNA complementary thereto are provided. Suitable fragments are at least 15 nucleotides in length, and encompass functional fragments, i.e., fragments which are of biological interest. For example, a functional fragment can express a desired adenoviral product or may be useful in production of recombinant viral vectors. Such fragments include the gene sequences and fragments listed in the tables herein. The tables provide the transcript regions and open reading frames in the SAdV-36, SAdV-42.1, SAdV-42.2 and SAdV-44 sequences. For certain genes, the transcripts and open reading frames (ORFs) are located on the strand complementary to that presented in SEQ ID NO:1, 33, 64 and 95. See, e.g., E2b, E4 and E2a. The calculated molecular weights of the encoded proteins are also shown. Note that the E1a open reading frame of SAdV-36, SAdV-42.1, SAdV-42.2 and/or SAdV-44 and the E2b open reading frame contain internal splice sites. These splice sites are noted in the table above.

The SAdV-36, SAdV-42.1, SAdV-42.2 and/or SAdV-44 adenoviral nucleic acid sequences are useful as therapeutic agents and in construction of a variety of vector systems and host cells. As used herein, a vector includes any suitable nucleic acid molecule including, naked DNA, a plasmid, a virus, a cosmid, or an episome. These sequences and products may be used alone or in combination with other adenoviral sequences or fragments, or in combination with elements from other adenoviral or non-adenoviral sequences. The SAdV-36, SAdV-42.1, SAdV-42.2 and/or SAdV-44 sequences are also useful as antisense delivery vectors, gene therapy vectors, or vaccine vectors. Thus, further provided are nucleic acid molecules, gene delivery vectors, and host cells which contain the SAdV-36, SAdV-42.1, SAdV-42.2 and/or SAdV-44 sequences.

For example, the invention encompasses a nucleic acid molecule containing simian Ad ITR sequences of the invention. In another example, the invention provides a nucleic acid molecule containing simian Ad sequences of the invention encoding a desired Ad gene product. Still other nucleic acid molecule constructed using the sequences of the invention will be readily apparent to one of skill in the art, in view of the information provided herein.

In one embodiment, the simian Ad gene regions identified herein may be used in a variety of vectors for delivery of a heterologous molecule to a cell. For example, vectors are generated for expression of an adenoviral capsid protein (or fragment thereof) for purposes of generating a viral vector in a packaging host cell. Such vectors may be designed for expression in trans. Alternatively, such vectors are designed to provide cells which stably contain sequences which express desired adenoviral functions, e.g., one or more of E1a, E1b, the terminal repeat sequences, E2a, E2b, E4, E4ORF6 region.

In addition, the adenoviral gene sequences and fragments thereof are useful for providing the helper functions necessary for production of helper-dependent viruses (e.g., adenoviral vectors deleted of essential functions, or adeno-associated viruses (AAV)). For such production methods, the SAdV-36, SAdV-42.1, SAdV-42.2 and SAdV-44 sequences can be utilized in such a method in a manner similar to those described for the human Ad. However, due to the differences in sequences between the SAdV-36, SAdV-42.1, SAdV-42.2 and SAdV-44 sequences and those of human Ad, the use of the SAdV-36, SAdV-42.1, SAdV-42.2 and SAdV-44 sequences greatly minimize or eliminate the possibility of homologous recombination with helper functions in a host cell carrying human Ad E1 functions, e.g., 293 cells, which may produce infectious adenoviral contaminants during rAAV production.

Methods of producing rAAV using adenoviral helper functions have been described at length in the literature with human adenoviral serotypes. See, e.g., U.S. Pat. No. 6,258,595 and the references cited therein. See, also, U.S. Pat. No. 5,871,982; WO 99/14354; WO 99/15685; WO 99/47691. These methods may also be used in production of non-human serotype AAV, including non-human primate AAV serotypes. The SAdV-36, SAdV-42.1, SAdV-42.2 and SAdV-44 sequences which provide the necessary helper functions (e.g., E1a, E1b, E2a and/or E4 ORF6) can be particularly useful in providing the necessary adenoviral function while minimizing or eliminating the possibility of recombination with any other adenoviruses present in the rAAV-packaging cell which are typically of human origin. Thus, selected genes or open reading frames of the SAdV-36, SAdV-42.1, SAdV-42.2 or SAdV-44 sequences may be utilized in these rAAV production methods.

Alternatively, recombinant SAdV-36, SAdV-42.1, SAdV-42.2 and/or SAdV-44 vectors may be utilized in these methods. Such recombinant adenoviral simian vectors may include, e.g., a hybrid chimp Ad/AAV in which chimp Ad sequences flank a rAAV expression cassette composed of, e.g., AAV 3' and/or 5' ITRs and a transgene under the control of regulatory sequences which control its expression. One of skill in the art will recognize that still other simian adenoviral vectors and/or SAdV-36, SAdV-42.1, SAdV-42.2 and/or SAdV-44 gene sequences will be useful for production of rAAV and other viruses dependent upon adenoviral helper.

In still another embodiment, nucleic acid molecules are designed for delivery and expression of selected adenoviral gene products in a host cell to achieve a desired physiologic effect. For example, a nucleic acid molecule containing sequences encoding an SAdV-36, SAdV-42.1, SAdV-42.2 and/or SAdV-44 E1a protein may be delivered to a subject for use as a cancer therapeutic. Optionally, such a molecule is formulated in a lipid-based carrier and preferentially targets cancer cells. Such a formulation may be combined with other cancer therapeutics (e.g., cisplatin, taxol, or the like). Still other uses for the adenoviral sequences provided herein will be readily apparent to one of skill in the art.

In addition, one of skill in the art will readily understand that the SAdV-36, SAdV-42.1, SAdV-42.2 and/or SAdV-44 sequences can be readily adapted for use for a variety of viral and non-viral vector systems for in vitro, ex vivo or in vivo delivery of therapeutic and immunogenic molecules. For example, the SAdV-36, SAdV-42.1, SAdV-42.2 and/or SAdV-44 simian Ad sequences can be utilized in a variety of rAd and non-rAd vector systems. Such vectors systems may include, e.g., plasmids, lentiviruses, retroviruses, poxviruses, vaccinia viruses, and adeno-associated viral systems, among others. Selection of these vector systems is not a limitation of the present invention.

The invention further provides molecules useful for production of the simian and simian-derived proteins of the invention. Such molecules which carry polynucleotides including the simian Ad DNA sequences of the invention can be in the form of naked DNA, a plasmid, a virus or any other genetic element.

B. SAdV-36, SAdV-42.1, SAdV-42.2 and SAdV-44 Adenoviral Proteins

Gene products of the SAdV-36, SAdV-42.1, SAdV-42.2 or SAdV-44 adenovirus, such as proteins, enzymes, and fragments thereof, which are encoded by the adenoviral nucleic acids described herein are provided. Further encompassed are SAdV-36, SAdV-42.1, SAdV-42.2 or SAdV-44 proteins, enzymes, and fragments thereof, having the amino acid sequences encoded by these nucleic acid sequences which are generated by other methods. Such proteins include those encoded by the open reading frames identified in Table 1, above, the proteins in Table 2, below, (also shown in the Sequence Listing) and fragments thereof of the proteins and polypeptides.

TABLE 2

PROTEIN SEQUENCES

| Regions | | SAdV-36 SEQ ID NO: | SAdV-42.1 SEQ ID NO: | SAdV-42.2 SEQ ID NO: | SAdV-44 SEQ ID NO: |
|---|---|---|---|---|---|
| E1a | | 32 | 61 | 92 | 123 |
| E1b | Small T/19K | 24 | 54 | 65 | 96 |
| | Large T/55K | 2 | 34 | 85 | 116 |
| | IX | 3 | 35 | 66 | 97 |
| L1 | 52/55D | 4 | 36 | 67 | 98 |
| | IIIa | 5 | 37 | 68 | 99 |
| L2 | Penton | 6 | 38 | 69 | 100 |
| | VII | 7 | 39 | 70 | 101 |
| | V | 8 | 40 | 71 | 102 |
| | pX | 9 | 41 | 72 | 103 |
| L3 | VI | 10 | 42 | 73 | 104 |
| | Hexon | 11 | 43 | 74 | 105 |
| | Endo protease | 12 | 44 | 75 | 106 |

TABLE 2-continued

PROTEIN SEQUENCES

| Regions | | SAdV-36 SEQ ID NO: | SAdV-42.1 SEQ ID NO: | SAdV-42.2 SEQ ID NO: | SAdV-44 SEQ ID NO: |
|---|---|---|---|---|---|
| L4 | 100 kD | 13 | 45 | 76 | 107 |
| | 33 kD homolog | 30 | 63 | 94 | 125 |
| | 22 kD | 26 | 56 | 87 | 118 |
| | VIII | 14 | 46 | 77 | 108 |
| E3 | 12.5k | 15 | 57 | 78 | 109 |
| | CR1-alpha | 27 | 47 | 88 | 110 |
| | gp19K | 16 | 48 | 79 | 111 |
| | CR1-beta | 17 | 49 | 80 | 112 |
| | CR1-gamma | 18 | 58 | 89 | 119 |
| | CR1-delta | 19 | — | — | — |
| | RID-alpha | 20 | 50 | 81 | 113 |
| | RID-beta | 28 | 51 | 82 | 114 |
| | 14.7 K | 21 | 59 | 90 | 120 |
| L5 | Fiber | 22 | 52 | 83 | 121 |

Thus, in one aspect, unique simian adenoviral 36 (SAdV-36), SAdV-42.1, SAdV-42.2 or SAdV-44 proteins which are substantially pure, i.e., are free of other viral and proteinaceous proteins are provided. Preferably, these proteins are at least 10% homogeneous, more preferably 60% homogeneous, and most preferably 95% homogeneous.

In one embodiment, unique simian-derived capsid proteins are provided. As used herein, a simian-derived capsid protein includes any adenoviral capsid protein that contains a SAdV-36, SAdV-42.1, SAdV-42.2 or SAdV-44 capsid protein or a fragment thereof, as defined above, including, without limitation, chimeric capsid proteins, fusion proteins, artificial capsid proteins, synthetic capsid proteins, and recombinant capsid proteins, without limitation to means of generating these proteins.

Suitably, these simian-derived capsid proteins contain one or more SAdV-36, SAdV-42.1, SAdV-42.2 or SAdV-44 regions or fragments thereof (e.g., a hexon, penton, fiber, or fragment thereof) in combination with capsid regions or fragments thereof of different adenoviral serotypes, or modified simian capsid proteins or fragments, as described herein. A "modification of a capsid protein associated with altered tropism" as used herein includes an altered capsid protein, i.e, a penton, hexon or fiber protein region, or fragment thereof, such as the knob domain of the fiber region, or a polynucleotide encoding same, such that specificity is altered. The simian-derived capsid may be constructed with one or more of the simian Ad of the invention or another Ad serotype which may be of human or non-human origin. Such Ad may be obtained from a variety of sources including the ATCC, commercial and academic sources, or the sequences of the Ad may be obtained from GenBank or other suitable sources.

The amino acid sequences of the penton protein of SAdV-36 (SEQ ID NO:6), SAdV-42.1 (SEQ ID NO:38), SAdV-42.2 (SEQ ID NO:69) and SAdV-44 (SEQ ID NO: 100) are provided. Suitably, this penton protein, or unique fragments thereof, may be utilized for a variety of purposes. Examples of suitable fragments include the penton having N-terminal and/or C-terminal truncations of about 50, 100, 150, or 200 amino acids, based upon the amino acid numbering provided above and in SEQ ID NO:6, 38, 69 and 100. Other suitable fragments include shorter internal, C-terminal, or N-terminal fragments. Further, the penton protein may be modified for a variety of purposes known to those of skill in the art.

Also provided are the amino acid sequences of the hexon protein of SAdV-36 (SEQ ID NO:11), SAdV-42.1 (SEQ ID NO:43), SAdV-42.2 (SEQ ID NO:74) and SAdV-44 (SEQ ID NO: 105). Suitably, this hexon protein, or unique fragments thereof, may be utilized for a variety of purposes. Examples of suitable fragments include the hexon having N-terminal and/or C-terminal truncations of about 50, 100, 150, 200, 300, 400, or 500 amino acids, based upon the amino acid numbering provided above and in SEQ ID NO: 11, 43, 74 or 105. Other suitable fragments include shorter internal, C-terminal, or N-terminal fragments. For example, one suitable fragment the loop region (domain) of the hexon protein, designated DE1 and FG1, or a hypervariable region thereof. Such fragments include the regions spanning amino acid residues about 125 to 443; about 138 to 441, or smaller fragments, such as those spanning about residue 138 to residue 163; about 170 to about 176; about 195 to about 203; about 233 to about 246; about 253 to about 264; about 287 to about 297; and about 404 to about 430 of the simian hexon proteins, with reference to SEQ ID NO: 11, 43, 74 or 105. Other suitable fragments may be readily identified by one of skill in the art. Further, the hexon protein may be modified for a variety of purposes known to those of skill in the art. Because the hexon protein is the determinant for serotype of an adenovirus, such artificial hexon proteins would result in adenoviruses having artificial serotypes. Other artificial capsid proteins can also be constructed using the chimp Ad penton sequences and/or fiber sequences of the invention and/or fragments thereof.

In one embodiment, an adenovirus having an altered hexon protein utilizing the sequences of a SAdV-36, SAdV-42.1, SAdV-42.2 and/or SAdV-44 hexon protein may be generated. One suitable method for altering hexon proteins is described in U.S. Pat. No. 5,922,315, which is incorporated by reference. In this method, at least one loop region of the adenovirus hexon is changed with at least one loop region of another adenovirus serotype. Thus, at least one loop region of such an altered adenovirus hexon protein is a simian Ad hexon loop region of SAdV-36, SAdV-42.1, SAdV-42.2 or SAdV-44. In one embodiment, a loop region of the SAdV-36, SAdV-42.1, SAdV-42.2 or SAdV-44 hexon protein is replaced by a loop region from another adenovirus serotype. In another embodiment, the loop region of the SAdV-36, SAdV-42.1, SAdV-42.2 or SAdV-44 hexon is used to replace a loop region from another adenovirus serotype. Suitable adenovirus serotypes may be readily selected from among human and non-human serotypes, as described herein. The selection of a suitable serotype is not a limitation of the present invention. Still other uses for the SAdV-36, SAdV-42.1, SAdV-42.2 or SAdV-44 hexon protein sequences will be readily apparent to those of skill in the art.

The amino acid sequences of the fiber proteins of SAdV-36 (SEQ ID NO:22), SAdV-42.1 (SEQ ID NO:52), SAdV-42.2 (SEQ ID NO:83) and SAdV-44 (SEQ ID NO:121) are also provided. Suitably, these fiber proteins, or unique fragments thereof, may be utilized for a variety of purposes. One suitable fragment is the fiber knob, located within SEQ ID NO: 22, 52, 83 or 121. Examples of other suitable fragments include the fiber having N-terminal and/or C-terminal truncations of about 50, 100, 150, or 200 amino acids, based upon the amino acid numbering provided in SEQ ID NO: 22, 52, 83 or 121. Still other suitable fragments include internal fragments. Further, the fiber protein may be modified using a variety of techniques known to those of skill in the art.

Unique fragments of the proteins of the SAdV-36, SAdV-42.1, SAdV-42.2 and/or SAdV-44 are at least 8 amino acids in length. However, fragments of other desired lengths can be readily utilized. In addition, modifications as may be introduced to enhance yield and/or expression of a SAdV-36, SAdV-42.1, SAdV-42.2 and/or SAdV-44 gene product, e.g., construction of a fusion molecule in which all or a fragment of the SAdV-36, SAdV-42.1, SAdV-42.2 and/or SAdV-44 gene product is fused (either directly or via a linker) with a fusion partner to enhance are provided herein. Other suitable modifications include, without limitation, truncation of a coding region (e.g., a protein or enzyme) to eliminate a pre- or pro-protein ordinarily cleaved and to provide the mature protein or enzyme and/or mutation of a coding region to provide a secretable gene product. Still other modifications will be readily apparent to one of skill in the art. Further encompassed are proteins having at least about 99% identity to the SAdV-36, SAdV-42.1, SAdV-42.2 and/or SAdV-44 proteins provided herein.

As described herein, vectors of the invention containing the adenoviral capsid proteins of SAdV-36, SAdV-42.1, SAdV-42.2 and/or SAdV-44 are particularly well suited for use in applications in which the neutralizing antibodies diminish the effectiveness of other Ad serotype based vectors, as well as other viral vectors. The rAd vectors are particularly advantageous in readministration for repeat gene therapy or for boosting immune response (vaccine titers).

Under certain circumstances, it may be desirable to use one or more of the SAdV-36, SAdV-42.1, SAdV-42.2 and/or SAdV-44 gene products (e.g., a capsid protein or a fragment thereof) to generate an antibody. The term "an antibody," as used herein, refers to an immunoglobulin molecule which is able to specifically bind to an epitope. The antibodies may exist in a variety of forms including, for example, high affinity polyclonal antibodies, monoclonal antibodies, synthetic antibodies, chimeric antibodies, recombinant antibodies and humanized antibodies. Such antibodies originate from immunoglobulin classes IgG, IgM, IgA, IgD and IgE.

Such antibodies may be generated using any of a number of methods know in the art. Suitable antibodies may be generated by well-known conventional techniques, e.g., Kohler and Milstein and the many known modifications thereof. Similarly desirable high titer antibodies are generated by applying known recombinant techniques to the monoclonal or polyclonal antibodies developed to these antigens [see, e.g., PCT Patent Application No. PCT/GB85/00392; British Patent Application Publication No. GB2188638A; Amit et al., 1986 *Science*, 233:747-753; Queen et al., 1989 *Proc. Nat'l. Acad. Sci. USA*, 86:10029-10033; PCT Patent Application No. PCT/WO9007861; and Riechmann et al., *Nature*, 332:323-327 (1988); Huse et al, 1988a *Science*, 246:1275-1281]. Alternatively, antibodies can be produced by manipulating the complementarity determining regions of animal or human antibodies to the antigen of this invention. See, e.g., E. Mark and PacIlin, "Humanization of Monoclonal Antibodies", Chapter 4, The Handbook of Experimental Pharmacology, Vol. 113, The Pharmacology of Monoclonal Antibodies, Springer-Verlag (June, 1994); Harlow et al., 1999, Using Antibodies: A Laboratory Manual, Cold Spring Harbor Laboratory Press, NY; Harlow et al., 1989, Antibodies: A Laboratory Manual, Cold Spring Harbor, N.Y.; Houston et al., 1988, *Proc. Natl. Acad. Sci. USA* 85:5879-5883; and Bird et al., 1988, *Science* 242:423-426. Further provided by the present invention are anti-idiotype antibodies (Ab2) and anti-anti-idiotype antibodies (Ab3). See, e.g., M. Wettendorff et al., "Modulation of anti-tumor immunity by anti-idiotypic antibodies." In Idiotypic Network and Diseases, ed. by J. Cerny and J. Hiernaux, 1990 *J. Am. Soc. Microbiol.*, Washington D.C.: pp. 203-229]. These anti-idiotype and anti-anti-idiotype antibodies are produced using techniques well known to those of skill in the art. These antibodies may be used for a variety of purposes, including diagnostic and clinical methods and kits.

Under certain circumstances, it may be desirable to introduce a detectable label or a tag onto a SAdV-36, SAdV-42.1, SAdV-42.2 and/or SAdV-44 gene product, antibody or other construct of the invention. As used herein, a detectable label is a molecule which is capable, alone or upon interaction with another molecule, of providing a detectable signal. Most desirably, the label is detectable visually, e.g. by fluorescence, for ready use in immunohistochemical analyses or immunofluorescent microscopy. For example, suitable labels include fluorescein isothiocyanate (FITC), phycoerythrin (PE), allophycocyanin (APC), coriphosphine-O (CPO) or tandem dyes, PE-cyanin-5 (PC5), and PE-Texas Red (ECD). All of these fluorescent dyes are commercially available, and their uses known to the art. Other useful labels include a colloidal gold label. Still other useful labels include radioactive compounds or elements. Additionally, labels include a variety of enzyme systems that operate to reveal a colorimetric signal in an assay, e.g., glucose oxidase (which uses glucose as a substrate) releases peroxide as a product which in the presence of peroxidase and a hydrogen donor such as tetramethyl benzidine (TMB) produces an oxidized TMB that is seen as a blue color. Other examples include horseradish peroxidase (HRP), alkaline phosphatase (AP), and hexokinase in conjunction with glucose-6-phosphate dehydrogenase which reacts with ATP, glucose, and NAD+ to yield, among other products, NADH that is detected as increased absorbance at 340 nm wavelength.

Other label systems that are utilized in the methods described herein are detectable by other means, e.g., colored latex microparticles [Bangs Laboratories, Indiana] in which a dye is embedded are used in place of enzymes to form conjugates with the target sequences provide a visual signal indicative of the presence of the resulting complex in applicable assays.

Methods for coupling or associating the label with a desired molecule are similarly conventional and known to those of skill in the art. Known methods of label attachment are described [see, for example, Handbook of Fluorescent probes and Research Chemicals, 6th Ed., R. P. M. Haugland, Molecular Probes, Inc., Eugene, Oreg., 1996; Pierce Catalog and Handbook, Life Science and Analytical Research Products, Pierce Chemical Company, Rockford, Ill., 1994/1995]. Thus, selection of the label and coupling methods do not limit this invention.

The sequences, proteins, and fragments of SAdV-36, SAdV-42.1, SAdV-42.2 and/or SAdV-44 may be produced by any suitable means, including recombinant production, chemical synthesis, or other synthetic means. Suitable production techniques are well known to those of skill in the art. See, e.g., Sambrook et al, Molecular Cloning: A Laboratory Manual, Cold Spring Harbor Press (Cold Spring Harbor, N.Y.). Alternatively, peptides can also be synthesized by the well known solid phase peptide synthesis methods (Merrifield, *J. Am. Chem. Soc.,* 85:2149 (1962); Stewart and Young, Solid Phase Peptide Synthesis (Freeman, San Francisco, 1969) pp. 27-62). These and other suitable production methods are within the knowledge of those of skill in the art and are not a limitation of the present invention.

In addition, one of skill in the art will readily understand that the SAdV-36, SAdV-42.1, SAdV-42.2 and/or SAdV-44 sequences can be readily adapted for use for a variety of viral and non-viral vector systems for in vitro, ex vivo or in vivo delivery of therapeutic and immunogenic molecules. For example, in one embodiment, the simian Ad capsid proteins and other simian adenovirus proteins described herein are used for non-viral, protein-based delivery of genes, proteins, and other desirable diagnostic, therapeutic and immunogenic molecules. In one such embodiment, a protein of the invention is linked, directly or indirectly, to a molecule for targeting to cells with a receptor for adenoviruses. Preferably, a capsid protein such as a hexon, penton, fiber or a fragment thereof having a ligand for a cell surface receptor is selected for such targeting. Suitable molecules for delivery are selected from among the therapeutic molecules described herein and their gene products. A variety of linkers including, lipids, polyLys, and the like may be utilized as linkers. For example, the simian penton protein may be readily utilized for such a purpose by production of a fusion protein using the simian penton sequences in a manner analogous to that described in Medina-Kauwe L K, et al, *Gene Ther.* 2001 May; 8(10):795-803 and Medina-Kauwe L K, et al, *Gene Ther.* 2001 December; 8(23): 1753-1761. Alternatively, the amino acid sequences of simian Ad protein IX may be utilized for targeting vectors to a cell surface receptor, as described in US Patent Appln 20010047081. Suitable ligands include a CD40 antigen, an RGD-containing or polylysine-containing sequence, and the like. Still other simian Ad proteins, including, e.g., the hexon protein and/or the fiber protein, may be used for used for these and similar purposes.

Still other SAdV-36, SAdV-42.1, SAdV-42.2 and/or SAdV-44 adenoviral proteins may be used as alone, or in combination with other adenoviral protein, for a variety of purposes which will be readily apparent to one of skill in the art. In addition, still other uses for the SAdV-36, SAdV-42.1, SAdV-42.2 and/or SAdV-44 adenoviral proteins will be readily apparent to one of skill in the art.

II. Recombinant Adenoviral Vectors

The compositions described herein include vectors that deliver a heterologous molecule to cells, either for therapeutic or vaccine purposes. As used herein, a vector may include any genetic element including, without limitation, naked DNA, a phage, transposon, cosmid, episome, plasmid, or a virus. Such vectors contain simian adenovirus DNA of SAdV-36, SAdV-42.1, SAdV-42.2 and/or SAdV-44, and a minigene. By "minigene" is meant the combination of a selected heterologous gene and the other regulatory elements necessary to drive translation, transcription and/or expression of the gene product in a host cell.

Typically, a SAdV-derived adenoviral vector is designed such that the minigene is located in a nucleic acid molecule which contains other adenoviral sequences in the region native to a selected adenoviral gene. The minigene may be inserted into an existing gene region to disrupt the function of that region, if desired. Alternatively, the minigene may be inserted into the site of a partially or fully deleted adenoviral gene. For example, the minigene may be located in the site of such as the site of a functional E1 deletion or functional E3 deletion, among others that may be selected. The term "functionally deleted" or "functional deletion" means that a sufficient amount of the gene region is removed or otherwise damaged, e.g., by mutation or modification, so that the gene region is no longer capable of producing functional products of gene expression. If desired, the entire gene region may be removed. Other suitable sites for gene disruption or deletion are discussed elsewhere in the application.

For example, for a production vector useful for generation of a recombinant virus, the vector may contain the minigene and either the 5' end of the adenoviral genome or the 3' end of the adenoviral genome, or both the 5' and 3' ends of the adenoviral genome. The 5' end of the adenoviral genome contains the 5' cis-elements necessary for packaging and replication; i.e., the 5' inverted terminal repeat (ITR) sequences (which function as origins of replication) and the native 5' packaging enhancer domains (that contain sequences necessary for packaging linear Ad genomes and enhancer elements for the E1 promoter). The 3' end of the adenoviral genome includes the 3' cis-elements (including the ITRs) necessary for packaging and encapsidation. Suitably, a recombinant adenovirus contains both 5' and 3' adenoviral cis-elements and the minigene is located between the 5' and 3' adenoviral sequences. A SAdV-36, SAdV-42.1, SAdV-42.2 and/or SAdV-44 based adenoviral vector may also contain additional adenoviral sequences.

Suitably, these SAdV-36, SAdV-42.1, SAdV-42.2 and/or SAdV-44 based adenoviral vectors contain one or more adenoviral elements derived from the adenoviral genome of the invention. In one embodiment, the vectors contain adenoviral ITRs from SAdV-36, SAdV-42.1, SAdV-42.2 and/or SAdV-44 and additional adenoviral sequences from the same adenoviral serotype. In another embodiment, the vectors contain adenoviral sequences that are derived from a different adenoviral serotype than that which provides the ITRs.

As defined herein, a pseudotyped adenovirus refers to an adenovirus in which the capsid protein of the adenovirus is from a different adenovirus than the adenovirus which provides the ITRs.

Further, chimeric or hybrid adenoviruses may be constructed using the adenoviruses described herein using techniques known to those of skill in the art. See, e.g., U.S. Pat. No. 7,291,498.

The selection of the adenoviral source of the ITRs and the source of any other adenoviral sequences present in vector is not a limitation of the present embodiment. A variety of adenovirus strains are available from the American Type Culture Collection, Manassas, Va., or available by request from a variety of commercial and institutional sources. Further, the sequences of many such strains are available from a variety of databases including, e.g., PubMed and GenBank. Homologous adenovirus vectors prepared from other simian or from human adenoviruses are described in the published literature [see, for example, U.S. Pat. No. 5,240,846]. The DNA sequences of a number of adenovirus types are available from GenBank, including type Ad5 [GenBank Accession No. M73260]. The adenovirus sequences may be obtained from any known adenovirus serotype, such as serotypes 2, 3, 4, 7, 12 and 40, and further including any of the presently identified human types. Similarly adenoviruses known to infect non-human animals (e.g., simians) may also be employed in the vector constructs of this invention. See, e.g., U.S. Pat. No. 6,083,716.

The viral sequences, helper viruses (if needed), and recombinant viral particles, and other vector components and sequences employed in the construction of the vectors described herein are obtained as described above. The SAdV-36, SAdV-42.1, SAdV-42.2 and/or SAdV-44 DNA sequences of the invention are employed to construct vectors and cell lines useful in the preparation of such vectors.

Modifications of the nucleic acid sequences forming the vectors of this invention, including sequence deletions, insertions, and other mutations may be generated using standard molecular biological techniques and are within the scope of this embodiment.

A. The "Minigene"

The methods employed for the selection of the transgene, the cloning and construction of the "minigene" and its insertion into the viral vector are within the skill in the art given the teachings provided herein.

1. The Transgene

The transgene is a nucleic acid sequence, heterologous to the vector sequences flanking the transgene, which encodes a polypeptide, protein, or other product, of interest. The nucleic acid coding sequence is operatively linked to regulatory components in a manner which permits transgene transcription, translation, and/or expression in a host cell.

The composition of the transgene sequence will depend upon the use to which the resulting vector will be put. For example, one type of transgene sequence includes a reporter sequence, which upon expression produces a detectable signal. Such reporter sequences include, without limitation, DNA sequences encoding β-lactamase, β-galactosidase (LacZ), alkaline phosphatase, thymidine kinase, green fluorescent protein (GFP), chloramphenicol acetyltransferase (CAT), luciferase, membrane bound proteins including, for example, CD2, CD4, CD8, the influenza hemagglutinin protein, and others well known in the art, to which high affinity antibodies directed thereto exist or can be produced by conventional means, and fusion proteins comprising a membrane bound protein appropriately fused to an antigen tag domain from, among others, hemagglutinin or Myc. These coding sequences, when associated with regulatory elements which drive their expression, provide signals detectable by conventional means, including enzymatic, radiographic, colorimetric, fluorescence or other spectrographic assays, fluorescent activating cell sorting assays and immunological assays, including enzyme linked immunosorbent assay (ELISA), radioimmunoassay (RIA) and immunohistochemistry. For example, where the marker sequence is the LacZ gene, the presence of the vector carrying the signal is detected by assays for beta-galactosidase activity. Where the transgene is GFP or luciferase, the vector carrying the signal may be measured visually by color or light production in a luminometer.

In one embodiment, the transgene is a non-marker sequence encoding a product which is useful in biology and medicine, such as proteins, peptides, RNA, enzymes, or catalytic RNAs. Desirable RNA molecules include tRNA, dsRNA, ribosomal RNA, catalytic RNAs, and antisense RNAs. One example of a useful RNA sequence is a sequence which extinguishes expression of a targeted nucleic acid sequence in the treated animal.

The transgene may be used for treatment, e.g., of genetic deficiencies, as a cancer therapeutic or vaccine, for induction of an immune response, and/or for prophylactic vaccine purposes. As used herein, induction of an immune response refers to the ability of a molecule (e.g., a gene product) to induce a T cell and/or a humoral immune response to the molecule. The invention further includes using multiple transgenes, e.g., to correct or ameliorate a condition caused by a multi-subunit protein. In certain situations, a different transgene may be used to encode each subunit of a protein, or to encode different peptides or proteins. This is desirable when the size of the DNA encoding the protein subunit is large, e.g., for an immunoglobulin, the platelet-derived growth factor, or a dystrophin protein. In order for the cell to produce the multi-subunit protein, a cell is infected with the recombinant virus containing each of the different subunits. Alternatively, different subunits of a protein may be encoded by the same transgene. In this case, a single transgene includes the DNA encoding each of the subunits, with the DNA for each subunit separated by an internal ribozyme entry site (IRES). This is desirable when the size of the DNA encoding each of the subunits is small, e.g., the total size of the DNA encoding the subunits and the IRES is less than five kilobases. As an alternative to an IRES, the DNA may be separated by sequences encoding a 2A peptide, which self-cleaves in a post-translational event. See, e.g., M. L. Donnelly, et al, *J. Gen. Virol.*, 78(Pt 1):13-21 (January 1997); Furler, S., et al, *Gene Ther.*, 8(11):864-873 (June 2001); Klump H., et al., *Gene Ther.*, 8(10):811-817 (May 2001). This 2A peptide is significantly smaller than an IRES, making it well suited for use when space is a limiting factor. However, the selected transgene may encode any biologically active product or other product, e.g., a product desirable for study.

Suitable transgenes may be readily selected by one of skill in the art. The selection of the transgene is not considered to be a limitation of this embodiment.

2. Regulatory Elements

In addition to the major elements identified above for the minigene, the vector also includes conventional control elements necessary which are operably linked to the transgene in a manner that permits its transcription, translation and/or expression in a cell transfected with the plasmid vector or infected with the virus produced by the invention. As used herein, "operably linked" sequences include both expression control sequences that are contiguous with the gene of interest and expression control sequences that act in trans or at a distance to control the gene of interest.

Expression control sequences include appropriate transcription initiation, termination, promoter and enhancer sequences; efficient RNA processing signals such as splicing and polyadenylation (polyA) signals; sequences that stabilize cytoplasmic mRNA; sequences that enhance translation efficiency (i.e., Kozak consensus sequence); sequences that enhance protein stability; and when desired, sequences that enhance secretion of the encoded product.

A great number of expression control sequences, including promoters which are native, constitutive, inducible and/or tissue-specific, are known in the art and may be utilized. Examples of constitutive promoters include, without limitation, the retroviral Rous sarcoma virus (RSV) LTR promoter (optionally with the RSV enhancer), the cytomegalovirus (CMV) promoter (optionally with the CMV enhancer) [see, e.g., Boshart et al, *Cell*, 41:521-530 (1985)], the SV40 promoter, the dihydrofolate reductase promoter, the 13-actin promoter, the phosphoglycerol kinase (PGK) promoter, and the EFla promoter [Invitrogen].

Inducible promoters allow regulation of gene expression and can be regulated by exogenously supplied compounds, environmental factors such as temperature, or the presence of a specific physiological state, e.g., acute phase, a particular differentiation state of the cell, or in replicating cells only. Inducible promoters and inducible systems are available from a variety of commercial sources, including, without limitation, Invitrogen, Clontech and Ariad. Many other systems have been described and can be readily selected by one of skill in the art. For example, inducible promoters include the zinc-inducible sheep metallothionine (MT) promoter and the dexamethasone (Dex)-inducible mouse mammary tumor virus (MMTV) promoter. Other inducible systems include the T7 polymerase promoter system [WO 98/10088]; the ecdysone insect promoter [No et al, *Proc. Natl. Acad. Sci. USA*, 93:3346-3351 (1996)], the tetracycline-repressible system [Gossen et al, *Proc. Natl. Acad. Sci. USA*, 89:5547-5551 (1992)], the tetracycline-inducible system [Gossen et al, *Science*, 268:1766-1769 (1995), see also Harvey et al, *Curr. Opin. Chem. Biol.*, 2:512-518 (1998)]. Other systems include the FK506 dimer, VP16 or p65 using castradiol, diphenol murislerone, the RU486-inducible system [Wang et al, *Nat. Biotech.*, 15:239-243 (1997) and Wang et al, *Gene Ther.*, 4:432-441 (1997)] and the rapamycin-inducible system [Magari et al, *J. Clin. Invest.*, 100:2865-2872 (1997)]. The effectiveness of some inducible promoters increases over time. In such cases one can enhance the effectiveness of such systems by inserting multiple repressors in tandem, e.g., TetR linked to a TetR by an IRES. Alternatively, one can wait at least 3 days before screening for the desired function. One can enhance expression of desired proteins by known means to enhance the effectiveness of this system. For example, using the Woodchuck Hepatitis Virus Posttranscriptional Regulatory Element (WPRE).

In another embodiment, the native promoter for the transgene will be used. The native promoter may be preferred when it is desired that expression of the transgene should mimic the native expression. The native promoter may be used when expression of the transgene must be regulated temporally or developmentally, or in a tissue-specific manner, or in response to specific transcriptional stimuli. In a further embodiment, other native expression control elements, such as enhancer elements, polyadenylation sites or Kozak consensus sequences may also be used to mimic the native expression.

Another embodiment of the transgene includes a transgene operably linked to a tissue-specific promoter. For instance, if expression in skeletal muscle is desired, a promoter active in muscle should be used. These include the promoters from genes encoding skeletal 13-actin, myosin light chain 2A, dystrophin, muscle creatine kinase, as well as synthetic muscle promoters with activities higher than naturally occurring promoters (see Li et al., *Nat. Biotech.*, 17:241-245 (1999)). Examples of promoters that are tissue-specific are known for liver (albumin, Miyatake et al., *J. Virol.*, 71:5124-32 (1997); hepatitis B virus core promoter, Sandig et al., *Gene Ther.*, 3:1002-9 (1996); alpha-fetoprotein (AFP), Arbuthnot et al., *Hum. Gene Ther.*, 7:1503-14 (1996)), bone osteocalcin (Stein et al., *Mol. Biol. Rep.*, 24:185-96 (1997)); bone sialoprotein (Chen et al., *J. Bone Miner. Res.*, 11:654-64 (1996)), lymphocytes (CD2, Hansal et al., *J. Immunol.*, 161:1063-8 (1998); immunoglobulin heavy chain; T cell receptor chain), neuronal such as neuron-specific enolase (NSE) promoter (Andersen et al., *Cell. Mol. Neurobiol.*, 13:503-15 (1993)), neurofilament light-chain gene (Piccioli et al., *Proc. Natl. Acad. Sci. USA*, 88:5611-5 (1991)), and the neuron-specific vgf gene (Piccioli et al., *Neuron*, 15:373-84 (1995)), among others.

Optionally, vectors carrying transgenes encoding therapeutically useful or immunogenic products may also include selectable markers or reporter genes may include sequences encoding geneticin, hygromicin or purimycin resistance, among others. Such selectable reporters or marker genes (preferably located outside the viral genome to be packaged into a viral particle) can be used to signal the presence of the plasmids in bacterial cells, such as ampicillin resistance. Other components of the vector may include an origin of replication. Selection of these and other promoters and vector elements are conventional and many such sequences are available [see, e.g., Sambrook et al, and references cited therein].

These vectors are generated using the techniques and sequences provided herein, in conjunction with techniques known to those of skill in the art. Such techniques include conventional cloning techniques of cDNA such as those described in texts [Sambrook et al, Molecular Cloning: A Laboratory Manual, Cold Spring Harbor Press, Cold Spring Harbor, N.Y.], use of overlapping oligonucleotide sequences of the adenovirus genomes, polymerase chain reaction, and any suitable method which provides the desired nucleotide sequence.

III. Production of the Viral Vector

In one embodiment, the simian adenoviral plasmids (or other vectors) are used to produce adenoviral vectors. In one embodiment, the adenoviral vectors are adenoviral particles which are replication—defective. In one embodiment, the adenoviral particles are rendered replication-defective by deletions in the E1a and/or E1b genes. Alternatively, the adenoviruses are rendered replication-defective by another means, optionally while retaining the E1a and/or E1b genes. The adenoviral vectors can also contain other mutations to the adenoviral genome, e.g., temperature-sensitive mutations or deletions in other genes. In other embodiments, it is desirable to retain an intact E1a and/or E1b region in the adenoviral vectors. Such an intact E1 region may be located in its native location in the adenoviral genome or placed in the site of a deletion in the native adenoviral genome (e.g., in the E3 region).

In the construction of useful simian adenovirus vectors for delivery of a gene to the human (or other mammalian) cell, a range of adenovirus nucleic acid sequences can be employed in the vectors. For example, all or a portion of the adenovirus delayed early gene E3 may be eliminated from the simian adenovirus sequence which forms a part of the recombinant virus. The function of simian E3 is believed to be irrelevant to the function and production of the recombinant virus particle. Simian adenovirus vectors may also be constructed having a deletion of at least the ORF6 region of the E4 gene, and more desirably because of the redundancy in the function of this region, the entire E4 region. Still another vector of this invention contains a deletion in the delayed early gene E2a. Deletions may also be made in any of the late genes L1 through L5 of the simian adenovirus genome. Similarly, deletions in the intermediate genes IX and IVa$_2$ may be useful for some purposes. Other deletions may be made in the other structural or non-structural adenovirus genes. The above discussed deletions may be used individually, i.e., an adenovirus sequence for use as described herein may contain deletions in only a single region. Alternatively, deletions of entire genes or portions thereof effective to destroy their biological activity may be used in any combination. For example, in one exemplary vector, the adenovirus sequence may have deletions of the E1 genes and the E4 gene, or of the E1, E2a and E3 genes, or of the E1 and E3 genes, or of E1, E2a and E4 genes, with or without deletion of E3, and so on. As discussed above, such deletions may be used in combination with other mutations, such as temperature-sensitive mutations, to achieve a desired result.

An adenoviral vector lacking any essential adenoviral sequences (e.g., E1a, E1b, E2a, E2b, E4 ORF6, L1, L2, L3, L4 and L5) may be cultured in the presence of the missing adenoviral gene products which are required for viral infectivity and propagation of an adenoviral particle. These helper functions may be provided by culturing the adenoviral vector in the presence of one or more helper constructs (e.g., a plasmid or virus) or a packaging host cell. See, for example, the techniques described for preparation of a "minimal" human Ad vector in International Patent Application Publication No. WO 96/13597, published May 9, 1996, and incorporated herein by reference.

1. Helper Viruses

Thus, depending upon the simian adenovirus gene content of the viral vectors employed to carry the minigene, a helper adenovirus or non-replicating virus fragment may be necessary to provide sufficient simian adenovirus gene sequences necessary to produce an infective recombinant viral particle containing the minigene. Useful helper viruses contain selected adenovirus gene sequences not present in the adenovirus vector construct and/or not expressed by the packaging cell line in which the vector is transfected. In one embodiment, the helper virus is replication-defective and contains a variety of adenovirus genes in addition to the sequences described above. Such a helper virus is desirably used in combination with an E1-expressing cell line.

Helper viruses may also be formed into poly-cation conjugates as described in Wu et al, *J. Biol. Chem.*, 264:16985-16987 (1989); K. J. Fisher and J. M. Wilson, *Biochem. J.*, 299:49 (Apr. 1, 1994). Helper virus may optionally contain a second reporter minigene. A number of such reporter genes are known to the art. The presence of a reporter gene on the helper virus which is different from the transgene on the adenovirus vector allows both the Ad vector and the helper virus to be independently monitored. This second reporter is used to enable separation between the resulting recombinant virus and the helper virus upon purification.

2. Complementation Cell Lines

To generate recombinant simian adenoviruses (Ad) deleted in any of the genes described above, the function of the deleted gene region, if essential to the replication and infectivity of the virus, must be supplied to the recombinant virus by a helper virus or cell line, i.e., a complementation or packaging cell line. In many circumstances, a cell line expressing the human E1 can be used to transcomplement the chimp Ad vector. This is particularly advantageous because, due to the diversity between the chimp Ad sequences of the invention and the human AdE1 sequences found in currently available packaging cells, the use of the current human E1-containing cells prevents the generation of replication-competent adenoviruses during the replication and production process. However, in certain circumstances, it will be desirable to utilize a cell line which expresses the E1 gene products can be utilized for production of an E1-deleted simian adenovirus. Such cell lines have been described. See, e.g., U.S. Pat. No. 6,083,716.

If desired, one may utilize the sequences provided herein to generate a packaging cell or cell line that expresses, at a minimum, the adenovirus E1 gene from SAdV36 under the transcriptional control of a promoter for expression in a selected parent cell line. Inducible or constitutive promoters may be employed for this purpose. Examples of such promoters are described in detail elsewhere in this specification. A parent cell is selected for the generation of a novel cell line expressing any desired SAdV36 gene. Without limitation, such a parent cell line may be HeLa [ATCC Accession No. CCL 2], A549 [ATCC Accession No. CCL 185], HEK 293, KB [CCL 17], Detroit [e.g., Detroit 510, CCL 72] and WI-38 [CCL 75] cells, among others. These cell lines are all available from the American Type Culture Collection, 10801 University Boulevard, Manassas, Va. 20110-2209. Other suitable parent cell lines may be obtained from other sources.

Such E1-expressing cell lines are useful in the generation of recombinant simian adenovirus E1 deleted vectors. Additionally, or alternatively, cell lines that express one or more simian adenoviral gene products, e.g., E1a, E1b, E2a, and/or E4 ORF6, can be constructed using essentially the same procedures are used in the generation of recombinant simian viral vectors. Such cell lines can be utilized to transcomplement adenovirus vectors deleted in the essential genes that encode those products, or to provide helper functions necessary for packaging of a helper-dependent virus (e.g., adeno-associated virus). The preparation of a host cell involves techniques such as assembly of selected DNA sequences. This assembly may be accomplished utilizing conventional techniques. Such techniques include cDNA and genomic cloning, which are well known and are described in Sambrook et al., cited above, use of overlapping oligonucleotide sequences of the adenovirus genomes, combined with polymerase chain reaction, synthetic methods, and any other suitable methods which provide the desired nucleotide sequence.

In still another alternative, the essential adenoviral gene products are provided in trans by the adenoviral vector and/or helper virus. In such an instance, a suitable host cell can be selected from any biological organism, including prokaryotic (e.g., bacterial) cells, and eukaryotic cells, including, insect cells, yeast cells and mammalian cells. Particularly desirable host cells are selected from among any mammalian species, including, without limitation, cells such as A549, WEHI, 3T3, 10T1/2, HEK 293 cells or PERC6 (both of which express functional adenoviral E1) [Fallaux, F J et al, (1998), Hum Gene Ther, 9:1909-1917], Saos, C2C12, L cells, HT1080, HepG2 and primary fibroblast, hepatocyte and myoblast cells derived from mammals including human, monkey, mouse, rat, rabbit, and hamster. The selection of the mammalian species providing the cells is not a limitation of this invention; nor is the type of mammalian cell, i.e., fibroblast, hepatocyte, tumor cell, etc.

3. Assembly of Viral Particle and Transfection of a Cell Line

Generally, when delivering the vector comprising the minigene by transfection, the vector is delivered in an amount from about 5 μg to about 100 μg DNA, and preferably about 10 to about 50 μg DNA to about $1 \times 10^4$ cells to about $1 \times 10^{13}$ cells, and preferably about $10^5$ cells. However, the relative amounts of vector DNA to host cells may be adjusted, taking into consideration such factors as the selected vector, the delivery method and the host cells selected.

The vector may be any vector known in the art or disclosed above, including naked DNA, a plasmid, phage, transposon, cosmids, episomes, viruses, etc. Introduction into the host cell of the vector may be achieved by any means known in the art or as disclosed above, including transfection, and infection. One or more of the adenoviral genes may be stably integrated into the genome of the host cell, stably expressed as episomes, or expressed transiently. The gene products may all be expressed transiently, on an episome or stably integrated, or some of the gene products may be expressed stably while others are expressed transiently. Furthermore, the promoters for each of the adenoviral genes may be selected independently from a constitutive promoter, an inducible promoter or a native adenoviral promoter. The promoters may be regulated by a specific physiological state of the organism or cell (i.e., by the differentiation state or in replicating or quiescent cells) or by exogenously-added factors, for example.

Introduction of the molecules (as plasmids or viruses) into the host cell may also be accomplished using techniques known to the skilled artisan and as discussed throughout the specification. In preferred embodiment, standard transfection techniques are used, e.g., $CaPO_4$ transfection or electroporation.

Assembly of the selected DNA sequences of the adenovirus (as well as the transgene and other vector elements into various intermediate plasmids), and the use of the plasmids and vectors to produce a recombinant viral particle are all achieved using conventional techniques. Such techniques include conventional cloning techniques of cDNA such as those described in texts [Sambrook et al, cited above], use of overlapping oligonucleotide sequences of the adenovirus genomes, polymerase chain reaction, and any suitable method which provides the desired nucleotide sequence. Standard transfection and co-transfection techniques are employed, e.g., $CaPO_4$ precipitation techniques. Other conventional methods employed include homologous recombination of the viral genomes, plaquing of viruses in agar overlay, methods of measuring signal generation, and the like.

For example, following the construction and assembly of the desired minigene-containing viral vector, the vector is transfected in vitro in the presence of a helper virus into the packaging cell line. Homologous recombination occurs between the helper and the vector sequences, which permits the adenovirus-transgene sequences in the vector to be replicated and packaged into virion capsids, resulting in the recombinant viral vector particles. The current method for producing such virus particles is transfection-based. However, the invention is not limited to such methods.

The resulting recombinant simian adenoviruses are useful in transferring a selected transgene to a selected cell. In in vivo experiments with the recombinant virus grown in the packaging cell lines, the E1-deleted recombinant simian adenoviral vectors of the invention demonstrate utility in transferring a transgene to a non-simian, preferably a human, cell.

IV. Use of the Recombinant Adenovirus Vectors

The recombinant simian SAdV-36, SAdV-42.1, SAdV-42.2 and/or SAdV-44 based vectors are useful for gene transfer to a human or non-simian veterinary patient in vitro, ex vivo, and in vivo.

The recombinant adenovirus vectors described herein can be used as expression vectors for the production of the products encoded by the heterologous genes in vitro. For example, the recombinant adenoviruses containing a gene inserted into the location of an E1 deletion may be transfected into an E1-expressing cell line as described above. Alternatively, replication-competent adenoviruses may be used in another selected cell line. The transfected cells are then cultured in the conventional manner, allowing the recombinant adenovirus to express the gene product from the promoter. The gene product may then be recovered from the culture medium by known conventional methods of protein isolation and recovery from culture.

A SAdV-36, SAdV-42.1, SAdV-42.2 and/or SAdV-44 derived recombinant simian adenoviral vector provides an efficient gene transfer vehicle that can deliver a selected transgene to a selected host cell in vivo or ex vivo even where the organism has neutralizing antibodies to one or more AAV serotypes. In one embodiment, the rAAV and the cells are mixed ex vivo; the infected cells are cultured using conventional methodologies; and the transduced cells are re-infused into the patient. These compositions are particularly well suited to gene delivery for therapeutic purposes and for immunization, including inducing protective immunity.

More commonly, the SAdV-36, SAdV-42.1, SAdV-42.2 and/or SAdV-44 recombinant adenoviral vectors will be utilized for delivery of therapeutic or immunogenic molecules, as described below. It will be readily understood for both applications, that the recombinant adenoviral vectors of the invention are particularly well suited for use in regimens involving repeat delivery of recombinant adenoviral vectors. Such regimens typically involve delivery of a series of viral vectors in which the viral capsids are alternated. The viral capsids may be changed for each subsequent administration, or after a pre-selected number of administrations of a particular serotype capsid (e.g., one, two, three, four or more). Thus, a regimen may involve delivery of a rAd with a first simian capsid, delivery with a rAd with a second simian capsid, and delivery with a third simian capsid. A variety of other regimens which use the Ad capsids of the invention alone, in combination with one another, or in combination with other adenoviruses (which are preferably immunologically non-crossreactive) will be apparent to those of skill in the art.

Optionally, such a regimen may involve administration of rAd with capsids of other non-human primate adenoviruses, human adenoviruses, or artificial sequences such as are described herein. Each phase of the regimen may involve administration of a series of injections (or other delivery routes) with a single Ad capsid followed by a series with another capsid from a different Ad source. Alternatively, the SAdV-36, SAdV-42.1, SAdV-42.2 and/or SAdV-44 vectors may be utilized in regimens involving other non-adenoviral-mediated delivery systems, including other viral systems, non-viral delivery systems, protein, peptides, and other biologically active molecules.

The following sections will focus on exemplary molecules which may be delivered via the adenoviral vectors of the invention.

A. Ad-Mediated Delivery of Therapeutic Molecules

In one embodiment, the above-described recombinant vectors are administered to humans according to published methods for gene therapy. A simian viral vector bearing the selected transgene may be administered to a patient, preferably suspended in a biologically compatible solution or pharmaceutically acceptable delivery vehicle. A suitable vehicle includes sterile saline. Other aqueous and non-aqueous isotonic sterile injection solutions and aqueous and non-aqueous sterile suspensions known to be pharmaceutically acceptable carriers and well known to those of skill in the art may be employed for this purpose.

The simian adenoviral vectors are administered in sufficient amounts to transduce the target cells and to provide sufficient levels of gene transfer and expression to provide a therapeutic benefit without undue adverse or with medically acceptable physiological effects, which can be determined by those skilled in the medical arts. Conventional and pharmaceutically acceptable routes of administration include, but are not limited to, direct delivery to the retina and other intraocular delivery methods, direct delivery to the liver, inhalation, intranasal, intravenous, intramuscular, intratracheal, subcutaneous, intradermal, rectal, oral and other parenteral routes of administration. Routes of administration may be combined, if desired, or adjusted depending upon the transgene or the condition. The route of administration primarily will depend on the nature of the condition being treated.

Dosages of the viral vector will depend primarily on factors such as the condition being treated, the age, weight and health of the patient, and may thus vary among patients. For example, a therapeutically effective adult human or veterinary dosage of the viral vector is generally in the range of from about 100 µl, to about 100 mL of a carrier containing concentrations of from about $1\times10^6$ to about $1\times10^{15}$ particles, about $1\times10^{11}$ to $1\times10^{13}$ particles, or about $1\times10^9$ to $1\times10^{12}$ particles virus. Dosages will range depending upon the size of the animal and the route of administration. For example, a suitable human or veterinary dosage (for about an 80 kg animal) for intramuscular injection is in the range of about $1\times10^9$ to about $5\times10^{12}$ particles per mL, for a single site. Optionally, multiple sites of administration may be delivered. In another example, a suitable human or veterinary dosage may be in the range of about $1\times10^{11}$ to about $1\times10^{15}$ particles for an oral formulation. One of skill in the art may adjust these doses, depending the route of administration, and the therapeutic or vaccinal application for which the recombinant vector is employed. The levels of expression of the transgene, or for an immunogen, the level of circulating antibody, can be monitored to determine the frequency of dosage administration. Yet other methods for determining the timing of frequency of administration will be readily apparent to one of skill in the art.

An optional method step involves the co-administration to the patient, either concurrently with, or before or after administration of the viral vector, of a suitable amount of a short acting immune modulator. The selected immune modulator is defined herein as an agent capable of inhibiting the formation of neutralizing antibodies directed against the recombinant vector of this invention or capable of inhibiting cytolytic T lymphocyte (CTL) elimination of the vector. The immune modulator may interfere with the interactions between the T helper subsets ($T_{H1}$ or $T_{H2}$) and B cells to inhibit neutralizing antibody formation. Alternatively, the immune modulator may inhibit the interaction between $T_{H1}$ cells and CTLs to reduce the occurrence of CTL elimination of the vector. A variety of useful immune modulators and dosages for use of same are disclosed, for example, in Yang et al., *J. Virol.*, 70(9) (September, 1996); International Patent Application Publication No. WO 96/12406, published May 2, 1996; and International Patent Application No. PCT/US96/03035, all incorporated herein by reference.

1. Therapeutic Transgenes

Useful therapeutic products encoded by the transgene include hormones and growth and differentiation factors including, without limitation, insulin, glucagon, growth hormone (GH), parathyroid hormone (PTH), growth hormone releasing factor (GRF), follicle stimulating hormone (FSH), luteinizing hormone (LH), human chorionic gonadotropin (hCG), vascular endothelial growth factor (VEGF), angiopoietins, angiostatin, granulocyte colony stimulating factor (GCSF), erythropoietin (EPO), connective tissue growth factor (CTGF), basic fibroblast growth factor (bFGF), acidic fibroblast growth factor (aFGF), epidermal growth factor (EGF), transforming growth factor (TGF), platelet-derived growth factor (PDGF), insulin growth factors I and II (IGF-I and IGF-II), any one of the transforming growth factor superfamily, including TGF, activins, inhibins, or any of the bone morphogenic proteins (BMP) BMPs 1-15, any one of the heregluin/neuregulin/ARIA/neu differentiation factor (NDF) family of growth factors, nerve growth factor (NGF), brain-derived neurotrophic factor (BDNF), neurotrophins NT-3 and NT-4/5, ciliary neurotrophic factor (CNTF), glial cell line derived neurotrophic factor (GDNF), neurturin, agrin, any one of the family of semaphorins/collapsins, netrin-1 and netrin-2, hepatocyte growth factor (HGF), ephrins, noggin, sonic hedgehog and tyrosine hydroxylase.

Other useful transgene products include proteins that regulate the immune system including, without limitation, cytokines and lymphokines such as thrombopoietin (TPO), interleukins (IL) IL-1 through IL-25 (including, e.g., IL-2, IL-4, IL-12 and IL-18), monocyte chemoattractant protein, leukemia inhibitory factor, granulocyte-macrophage colony stimulating factor, Fas ligand, tumor necrosis factors and, interferons, and, stem cell factor, flk-2/flt3 ligand. Gene products produced by the immune system are also useful in the invention. These include, without limitation, immunoglobulins IgG, IgM, IgA, IgD and IgE, chimeric immunoglobulins, humanized antibodies, single chain antibodies, T cell receptors, chimeric T cell receptors, single chain T cell receptors, class I and class II MHC molecules, as well as engineered immunoglobulins and MHC molecules. Useful gene products also include complement regulatory proteins such as complement regulatory proteins, membrane cofactor protein (MCP), decay accelerating factor (DAF), CR1, CF2 and CD59.

Still other useful gene products include any one of the receptors for the hormones, growth factors, cytokines, lymphokines, regulatory proteins and immune system proteins. The invention encompasses receptors for cholesterol regulation, including the low density lipoprotein (LDL) receptor, high density lipoprotein (HDL) receptor, the very low density lipoprotein (VLDL) receptor, and the scavenger receptor. The invention also encompasses gene products such as members of the steroid hormone receptor superfamily including glucocorticoid receptors and estrogen receptors, Vitamin D receptors and other nuclear receptors. In addition, useful gene products include transcription factors such as jun, fos, max, mad, serum response factor (SRF), AP-1, AP2, myb, MyoD and myogenin, ETS-box containing proteins, TFE3, E2F, ATF1, ATF2, ATF3, ATF4, ZF5, NFAT, CREB, HNF-4, C/EBP, SP1, CCAAT-box binding proteins, interferon regulation factor (IRF-1), Wilms tumor protein, ETS-binding protein, STAT, GATA-box binding proteins, e.g., GATA-3, and the forkhead family of winged helix proteins.

Other useful gene products include, carbamoyl synthetase I, ornithine transcarbamylase, arginosuccinate synthetase, arginosuccinate lyase, arginase, fumarylacetacetate hydrolase, phenylalanine hydroxylase, alpha-1 antitrypsin, glucose-6-phosphatase, porphobilinogen deaminase, factor VIII, factor IX, cystathione beta-synthase, branched chain ketoacid decarboxylase, albumin, isovaleryl-coA dehydrogenase, propionyl CoA carboxylase, methyl malonyl CoA mutase, glutaryl CoA dehydrogenase, insulin, beta-glucosidase, pyruvate carboxylate, hepatic phosphorylase, phosphorylase kinase, glycine decarboxylase, H-protein, T-protein, a cystic fibrosis transmembrane regulator (CFTR) sequence, and a dystrophin cDNA sequence.

Other useful gene products include non-naturally occurring polypeptides, such as chimeric or hybrid polypeptides having a non-naturally occurring amino acid sequence containing insertions, deletions or amino acid substitutions. For example, single-chain engineered immunoglobulins could be useful in certain immunocompromised patients. Other types of non-naturally occurring gene sequences include antisense molecules and catalytic nucleic acids, such as ribozymes, which could be used to reduce overexpression of a target.

Reduction and/or modulation of expression of a gene are particularly desirable for treatment of hyperproliferative conditions characterized by hyperproliferating cells, as are cancers and psoriasis. Target polypeptides include those polypeptides which are produced exclusively or at higher levels in hyperproliferative cells as compared to normal cells. Target antigens include polypeptides encoded by oncogenes such as myb, myc, fyn, and the translocation gene bcr/abl, ras, src, P53, neu, trk and EGRF. In addition to oncogene products as target antigens, target polypeptides for anti-cancer treatments and protective regimens include variable regions of antibodies made by B cell lymphomas and variable regions of T cell receptors of T cell lymphomas which, in some embodiments, are also used as target antigens for autoimmune disease. Other tumor-associated polypeptides can be used as target polypeptides such as polypeptides which are found at higher levels in tumor cells including the polypeptide recognized by monoclonal antibody 17-1A and folate binding polypeptides.

Other suitable therapeutic polypeptides and proteins include those which may be useful for treating individuals suffering from autoimmune diseases and disorders by conferring a broad based protective immune response against targets that are associated with autoimmunity including cell receptors and cells which produce self-directed antibodies. T cell mediated autoimmune diseases include Rheumatoid arthritis (RA), multiple sclerosis (MS), Sjögren's syndrome, sarcoidosis, insulin dependent diabetes mellitus (IDDM), autoimmune thyroiditis, reactive arthritis, ankylosing spondylitis, scleroderma, polymyositis, dermatomyositis, psoriasis, vasculitis, Wegener's granulomatosis, Crohn's disease and ulcerative colitis. Each of these diseases is characterized by T cell receptors (TCRs) that bind to endogenous antigens and initiate the inflammatory cascade associated with autoimmune diseases.

The simian adenoviral vectors of the invention are particularly well suited for therapeutic regimens in which multiple adenoviral-mediated deliveries of transgenes is desired, e.g., in regimens involving redelivery of the same transgene or in combination regimens involving delivery of other transgenes. Such regimens may involve administration of a SAdV-36, SAdV-42.1, SAdV-42.2 and/or SAdV-44 simian adenoviral vector, followed by re-administration with a vector from the same serotype adenovirus. Particularly desirable regimens involve administration of a SAdV-36, SAdV-42.1, SAdV-42.2 and/or SAdV-44 simian adenoviral vector, in which the source of the adenoviral capsid sequences of the vector delivered in the first administration differs from the source of adenoviral capsid sequences of the viral vector utilized in one or more of the subsequent administrations. For example, a therapeutic regimen involves administration of a SAdV-36, SAdV-42.1, SAdV-42.2 and/or SAdV-44 vector and repeat administration with one or more adenoviral vectors of the same or different serotypes. In another example, a therapeutic regimen involves administration of an adenoviral vector followed by repeat administration with a SAdV-36, SAdV-42.1, SAdV-42.2 and/or SAdV-44 vector which has a capsid which differs from the source of the capsid in the first delivered adenoviral vector, and optionally further administration with another vector which is the same or, preferably, differs from the source of the adenoviral capsid of the vector in the prior administration steps. These regimens are not limited to delivery of adenoviral vectors constructed using the SAdV-36, SAdV-42.1, SAdV-42.2 and/or SAdV-44 simian sequences. Rather, these regimens can readily utilize vectors other adenoviral sequences, including, without limitation, other simian adenoviral sequences, (e.g., Pan9 or C68, C1, etc), other non-human primate adenoviral sequences, or human adenoviral sequences, in combination with one or more of the SAdV-36, SAdV-42.1, SAdV-42.2 or SAdV-44 vectors. Examples of such simian, other non-human primate and human adenoviral serotypes are discussed elsewhere in this document. Further, these therapeutic regimens may involve either simultaneous or sequential delivery of SAdV-36, SAdV-42.1, SAdV-42.2 and/or SAdV-44 adenoviral vectors in combination with non-adenoviral vectors, non-viral vectors, and/or a variety of other therapeutically useful compounds or molecules. The invention is not limited to these therapeutic regimens, a variety of which will be readily apparent to one of skill in the art.

B. Ad-Mediated Delivery of Immunogenic Transgenes

The recombinant SAdV-36, SAdV-42.1, SAdV-42.2 and/or SAdV-44 vectors may also be employed as immunogenic compositions. As used herein, an immunogenic composition is a composition to which a humoral (e.g., antibody) or cellular (e.g., a cytotoxic T cell) response is mounted to a transgene product delivered by the immunogenic composition following delivery to a mammal, and preferably a primate. A recombinant simian Ad can contain in any of its adenovirus sequence deletions a gene encoding a desired immunogen. The simian adenovirus is likely to be better suited for use as a live recombinant virus vaccine in different animal species compared to an adenovirus of human origin, but is not limited to such a use. The recombinant adenoviruses can be used as prophylactic or therapeutic vaccines against any pathogen for which the antigen(s) crucial for induction of an immune response and able to limit the spread of the pathogen has been identified and for which the cDNA is available.

Such vaccinal (or other immunogenic) compositions are formulated in a suitable delivery vehicle, as described above. Generally, doses for the immunogenic compositions are in the range defined above for therapeutic compositions. The levels of immunity of the selected gene can be monitored to determine the need, if any, for boosters. Following an assessment of antibody titers in the serum, optional booster immunizations may be desired.

Optionally, a vaccinal composition of the invention may be formulated to contain other components, including, e.g., adjuvants, stabilizers, pH adjusters, preservatives and the like. Such components are well known to those of skill in the vaccine art. Examples of suitable adjuvants include, without limitation, liposomes, alum, monophosphoryl lipid A, and any biologically active factor, such as cytokine, an interleukin, a chemokine, a ligands, and optimally combinations thereof. Certain of these biologically active factors can be expressed in vivo, e.g., via a plasmid or viral vector. For example, such an adjuvant can be administered with a priming DNA vaccine encoding an antigen to enhance the antigen-specific immune response compared with the immune response generated upon priming with a DNA vaccine encoding the antigen only.

The recombinant adenoviruses are administered in a "an immunogenic amount", that is, an amount of recombinant adenovirus that is effective in a route of administration to transfect the desired cells and provide sufficient levels of expression of the selected gene to induce an immune response. Where protective immunity is provided, the recombinant adenoviruses are considered to be vaccine compositions useful in preventing infection and/or recurrent disease.

Alternatively, or in addition, the vectors of the invention may contain a transgene encoding a peptide, polypeptide or protein which induces an immune response to a selected immunogen. The recombinant SAdV-36, SAdV-42.1, SAdV-42.2 and SAdV-44 vectors are expected to be highly efficacious at inducing cytolytic T cells and antibodies to the inserted heterologous antigenic protein expressed by the vector.

For example, immunogens may be selected from a variety of viral families. Example of viral families against which an immune response would be desirable include, the picornavirus family, which includes the genera rhinoviruses, which are responsible for about 50% of cases of the common cold; the genera enteroviruses, which include polioviruses, coxsackieviruses, echoviruses, and human enteroviruses such as hepatitis A virus; and the genera apthoviruses, which are responsible for foot and mouth diseases, primarily in non-human animals. Within the picornavirus family of viruses, target antigens include the VP1, VP2, VP3, VP4, and VPG. Another viral family includes the calcivirus family, which encompasses the Norwalk group of viruses, which are an important causative agent of epidemic gastroenteritis. Still another viral family desirable for use in targeting antigens for inducing immune responses in humans and non-human animals is the togavirus family, which includes the genera alphavirus, which include Sindbis viruses, RossRiver virus, and Venezuelan, Eastern & Western Equine encephalitis, and rubivirus, including Rubella virus. The flaviviridae family includes dengue, yellow fever, Japanese encephalitis, St. Louis encephalitis and tick borne encephalitis viruses. Other target antigens may be generated from the Hepatitis C or the coronavirus family, which includes a number of non-human viruses such as infectious bronchitis virus (poultry), porcine transmissible gastroenteric virus (pig), porcine hemagglutinating encephalomyelitis virus (pig), feline infectious peritonitis virus (cats), feline enteric coronavirus (cat), canine coronavirus (dog), and human respiratory coronaviruses, which may cause the common cold and/or non-A, B or C hepatitis. Within the coronavirus family, target antigens include the E1 (also called M or matrix protein), E2 (also called S or Spike protein), E3 (also called HE or hemagglutin-elterose) glycoprotein (not present in all coronaviruses), or N (nucleocapsid). Still other antigens may be targeted against the rhabdovirus family, which includes the genera vesiculovirus (e.g., Vesicular Stomatitis Virus), and the general lyssavirus (e.g., rabies).

Within the rhabdovirus family, suitable antigens may be derived from the G protein or the N protein. The family filoviridae, which includes hemorrhagic fever viruses such as Marburg and Ebola virus, may be a suitable source of antigens. The paramyxovirus family includes parainfluenza Virus Type 1, parainfluenza Virus Type 3, bovine parainfluenza Virus Type 3, rubulavirus (mumps virus), parainfluenza Virus Type 2, parainfluenza virus Type 4, Newcastle disease virus (chickens), rinderpest, morbillivirus, which includes measles and canine distemper, and pneumovirus, which includes respiratory syncytial virus. The influenza virus is classified within the family orthomyxovirus and is a suitable source of antigen (e.g., the HA protein, the N1 protein). The bunyavirus family includes the genera bunyavirus (California encephalitis, La Crosse), phlebovirus (Rift Valley Fever), hantavirus (puremala is a hemahagin fever virus), nairovirus (Nairobi sheep disease) and various unassigned bungaviruses. The arenavirus family provides a source of antigens against LCM and Lassa fever virus. The reovirus family includes the genera reovirus, rotavirus (which causes acute gastroenteritis in children), orbiviruses, and cultivirus (Colorado Tick fever, Lebombo (humans), equine encephalosis, blue tongue).

The retrovirus family includes the sub-family oncorivirinal which encompasses such human and veterinary diseases as feline leukemia virus, HTLVI and HTLVII, lentivirinal (which includes human immunodeficiency virus (HIV), simian immunodeficiency virus (SW), feline immunodeficiency virus (FIV), equine infectious anemia virus, and spumavirinal). Among the lentiviruses, many suitable antigens have been described and can readily be selected. Examples of suitable HIV and SIV antigens include, without limitation the gag, pol, Vif, Vpx, VPR, Env, Tat, Nef, and Rev proteins, as well as various fragments thereof. For example, suitable fragments of the Env protein may include any of its subunits such as the gp 120, gp 160, gp41, or smaller fragments thereof, e.g., of at least about 8 amino acids in length. Similarly, fragments of the tat protein may be selected. [See, U.S. Pat. No. 5,891,994 and U.S. Pat. No. 6,193,981.] See, also, the HIV and SIV proteins described in D. H. Barouch et al, J. Virol., 75(5):2462-2467 (March 2001), and R. R. Amara, et al, Science, 292:69-74 (6 Apr. 2001). In another example, the HIV and/or SIV immunogenic proteins or peptides may be used to form fusion proteins or other immunogenic molecules. See, e.g., the HIV-1 Tat and/or Nef fusion proteins and immunization regimens described in WO 01/54719, published Aug. 2, 2001, and WO 99/16884, published Apr. 8, 1999. The invention is not limited to the HIV and/or SIV immunogenic proteins or peptides described herein. In addition, a variety of modifications to these proteins have been described or could readily be made by one of skill in the art. See, e.g., the modified gag protein that is described in U.S. Pat. No. 5,972,596. Further, any desired HIV and/or SIV immunogens may be delivered alone or in combination. Such combinations may include expression from a single vector or from multiple vectors. Optionally, another combination may involve delivery of one or more expressed immunogens with delivery of one or more of the immunogens in protein form. Such combinations are discussed in more detail below.

The papovavirus family includes the sub-family polyomaviruses (BKU and JCU viruses) and the sub-family papillomavirus (associated with cancers or malignant progression of papilloma). The adenovirus family includes viruses (EX, AD7, ARD, O.B.) which cause respiratory disease and/or enteritis. The parvovirus family feline parvovirus (feline enteritis), feline panleucopeniavirus, canine parvovirus, and porcine parvovirus. The herpesvirus family includes the sub-family alphaherpesvirinae, which encompasses the genera simplexvirus (HSVI, HSVII), varicellovirus (pseudorabies, varicella zoster) and the sub-family betaherpesvirinae, which includes the genera cytomegalovirus (HCMV, muromegalovirus) and the sub-family gammaherpesvirinae, which includes the genera lymphocryptovirus, EBV (Burkitts lymphoma), infectious rhinotracheitis, Marek's disease virus, and rhadinovirus. The poxvirus family includes the sub-family chordopoxvirinae, which encompasses the genera orthopoxvirus (Variola (Smallpox) and Vaccinia (Cowpox)), parapoxvirus, avipoxvirus, capripoxvirus, leporipoxvirus, suipoxvirus, and the sub-family entomopoxvirinae. The hepadnavirus family includes the Hepatitis B virus. One unclassified virus which may be suitable source of antigens is the Hepatitis delta virus. Still other viral sources may include avian infectious bursal disease virus and porcine respiratory and reproductive syndrome virus. The alphavirus family includes equine arteritis virus and various Encephalitis viruses.

Immunogens which are useful to immunize a human or non-human animal against other pathogens include, e.g., bacteria, fungi, parasitic microorganisms or multicellular parasites which infect human and non-human vertebrates, or from a cancer cell or tumor cell. Examples of bacterial pathogens include pathogenic gram-positive cocci include pneumococci; staphylococci; and streptococci. Pathogenic gram-negative cocci include meningococcus; gonococcus. Pathogenic enteric gram-negative bacilli include enterobacteriaceae; pseudomonas, acinetobacteria and eikenella; melioidosis; salmonella; shigella; haemophilus; moraxella; *H. ducreyi* (which causes chancroid); brucella; *Franisella tularensis* (which causes tularemia); yersinia (pasteurella); streptobacillus moniliformis and spirillum; Gram-positive bacilli include listeria monocytogenes; erysipelothrix rhusiopathiae; *Corynebacterium diphtheria* (diphtheria); cholera; *B. anthracis* (anthrax); donovanosis (granuloma inguinale); and bartonellosis. Diseases caused by pathogenic anaerobic bacteria include tetanus; botulism; other clostridia; tuberculosis; leprosy; and other mycobacteria. Pathogenic spirochetal diseases include syphilis; treponematoses: yaws, pinta and endemic syphilis; and leptospirosis. Other infections caused by higher pathogen bacteria and pathogenic fungi include actinomycosis; nocardiosis; cryptococcosis, blastomycosis, histoplasmosis and coccidioidomycosis; candidiasis, aspergillosis, and mucormycosis; sporotrichosis; paracoccidiodomycosis, petriellidiosis, torulopsosis, mycetoma and chromomycosis; and dermatophytosis. Rickettsial infections include Typhus fever, Rocky Mountain spotted fever, Q fever, and Rickettsialpox. Examples of mycoplasma and chlamydial infections include: mycoplasma pneumoniae; lymphogranuloma venereum; psittacosis; and perinatal chlamydial infections. Pathogenic eukaryotes encompass pathogenic protozoans and helminths and infections produced thereby include: amebiasis; malaria; leishmaniasis; trypanosomiasis; toxoplasmosis; *Pneumocystis carinii; Trichans; Toxoplasma gondii*; babesiosis; giardiasis; trichinosis; filariasis; schistosomiasis; nematodes; trematodes or flukes; and cestode (tapeworm) infections.

Many of these organisms and/or toxins produced thereby have been identified by the Centers for Disease Control [(CDC), Department of Heath and Human Services, USA], as agents which have potential for use in biological attacks. For example, some of these biological agents, include, *Bacillus anthracis* (anthrax), *Clostridium botulinum* and its toxin (botulism), *Yersinia pestis* (plague), variola major (smallpox), *Francisella tularensis* (tularemia), and viral hemorrhagic fevers [filoviruses (e.g., Ebola, Marburg], and arenaviruses [e.g., Lassa, Machupo]), all of which are currently classified as Category A agents; *Coxiella burnetti* (Q fever); Brucella species (brucellosis), *Burkholderia mallei* (glanders), *Burkholderia pseudomallei* (meloidosis), *Ricinus communis* and its toxin (ricin toxin), *Clostridium perfringens* and its toxin (epsilon toxin), *Staphylococcus* species and their toxins (enterotoxin B), *Chlamydia psittaci* (psittacosis), water safety threats (e.g., *Vibrio cholerae, Crytosporidium parvum*), Typhus fever (*Richettsia powazekii*), and viral encephalitis (alphaviruses, e.g., Venezuelan equine encephalitis; eastern equine encephalitis; western equine encephalitis); all of which are currently classified as Category B agents; and Nipan virus and hantaviruses, which are currently classified as Category C agents. In addition, other organisms, which are so classified or differently classified, may be identified and/or used for such a purpose in the future. It will be readily understood that the viral vectors and other constructs described herein are useful to deliver antigens from these organisms, viruses, their toxins or other by-products, which will prevent and/or treat infection or other adverse reactions with these biological agents.

Administration of the SAdV-36, SAdV-42.1, SAdV-42.2 and/or SAdV-44 vectors to deliver immunogens against the variable region of the T cells is anticipated to elicit an immune response including CTLs to eliminate those T cells. In RA, several specific variable regions of TCRs which are involved in the disease have been characterized. These TCRs include V-3, V-14, V-17 and Va-17. Thus, delivery of a nucleic acid sequence that encodes at least one of these polypeptides will elicit an immune response that will target T cells involved in RA. In MS, several specific variable regions of TCRs which are involved in the disease have been characterized. These TCRs include V-7 and Va-10. Thus, delivery of a nucleic acid sequence that encodes at least one of these polypeptides will elicit an immune response that will target T cells involved in MS. In scleroderma, several specific variable regions of TCRs which are involved in the disease have been characterized. These TCRs include V-6, V-8, V-14 and Va-16, Va-3C, Va-7, Va-14, Va-15, Va-16, Va-28 and Va-12. Thus, delivery of a recombinant simian adenovirus that encodes at least one of these polypeptides will elicit an immune response that will target T cells involved in scleroderma.

C. Ad-Mediated Delivery Methods

The therapeutic levels, or levels of immunity, of the selected gene can be monitored to determine the need, if any, for boosters. Following an assessment of CD8+T cell response; or optionally, antibody titers, in the serum, optional booster immunizations may be desired. Optionally, the recombinant SAdV-36, SAdV-42.1, SAdV-42.2 and/or SAdV-44 vectors may be delivered in a single administration or in various combination regimens, e.g., in combination with a regimen or course of treatment involving other active ingredients or in a prime-boost regimen. A variety of such regimens have been described in the art and may be readily selected.

For example, prime-boost regimens may involve the administration of a DNA (e.g., plasmid) based vector to prime the immune system to second, booster, administration with a traditional antigen, such as a protein or a recombinant virus carrying the sequences encoding such an antigen. See, e.g., WO 00/11140, published Mar. 2, 2000, incorporated by reference. Alternatively, an immunization regimen may involve the administration of a recombinant SAdV-36, SAdV-42.1, SAdV-42.2 and/or SAdV-44 vector to boost the immune response to a vector (either viral or DNA-based) carrying an antigen, or a protein. In still another alternative, an immunization regimen involves administration of a protein followed by booster with a vector encoding the antigen.

In one embodiment, a method of priming and boosting an immune response to a selected antigen by delivering a plasmid DNA vector carrying said antigen, followed by boosting with a recombinant SAdV-36, SAdV-42.1, SAdV-42.2 and/or SAdV-44 vector is described. In one embodiment, the prime-boost regimen involves the expression of multiproteins from the prime and/or the boost vehicle. See, e.g., R. R. Amara, Science, 292:69-74 (6 Apr. 2001) which describes a multiprotein regimen for expression of protein subunits useful for generating an immune response against HIV and SIV. For example, a DNA prime may deliver the Gag, Pol, Vif, VPX and Vpr and Env, Tat, and Rev from a single transcript. Alternatively, the SIV Gag, Pol and HIV-1 Env is delivered in a recombinant SAdV-36, SAdV-42.1, SAdV-42.2 and/or SAdV-44 adenovirus construct. Still other regimens are described in WO 99/16884 and WO 01/54719.

However, the prime-boost regimens are not limited to immunization for HIV or to delivery of these antigens. For example, priming may involve delivering with a first SAdV-36, SAdV-42.1, SAdV-42.2 and/or SAdV-44 vector followed by boosting with a second Ad vector, or with a composition containing the antigen itself in protein form. In one example, the prime-boost regimen can provide a protective immune response to the virus, bacteria or other organism from which the antigen is derived. In another embodiment, the prime-boost regimen provides a therapeutic effect that can be measured using convention assays for detection of the presence of the condition for which therapy is being administered.

The priming composition may be administered at various sites in the body in a dose dependent manner, which depends on the antigen to which the desired immune response is being targeted. The amount or situs of injection(s) or to pharmaceutical carrier is not a limitation. Rather, the regimen may involve a priming and/or boosting step, each of which may include a single dose or dosage that is administered hourly, daily, weekly or monthly, or yearly. As an example, the mammals may receive one or two doses containing between about 10 μg to about 50 μg of plasmid in carrier. A desirable amount of a DNA composition ranges between about 1 μg to about 10,000 μg of the DNA vector. Dosages may vary from about 1 μg to 1000 μg DNA per kg of subject body weight. The amount or site of delivery is desirably selected based upon the identity and condition of the mammal.

The dosage unit of the vector suitable for delivery of the antigen to the mammal is described herein. The vector is prepared for administration by being suspended or dissolved in a pharmaceutically or physiologically acceptable carrier such as isotonic saline; isotonic salts solution or other formulations that will be apparent to those skilled in such administration. The appropriate carrier will be evident to those skilled in the art and will depend in large part upon the route of administration. The compositions described herein may be administered to a mammal according to the routes described above, in a sustained release formulation using a biodegradable biocompatible polymer, or by on-site delivery using micelles, gels and liposomes. Optionally, the priming step also includes administering with the priming composition, a suitable amount of an adjuvant, such as are defined herein.

Preferably, a boosting composition is administered about 2 to about 27 weeks after administering the priming composition to the mammalian subject. The administration of the boosting composition is accomplished using an effective amount of a boosting composition containing or capable of delivering the same antigen as administered by the priming DNA vaccine. The boosting composition may be composed of a recombinant viral vector derived from the same viral source (e.g., adenoviral sequences of the invention) or from another source. Alternatively, the "boosting composition" can be a composition containing the same antigen as encoded in the priming DNA vaccine, but in the form of a protein or peptide, which composition induces an immune response in the host. In another embodiment, the boosting composition contains a DNA sequence encoding the antigen under the control of a regulatory sequence directing its expression in a mammalian cell, e.g., vectors such as well-known bacterial or viral vectors. The primary requirements of the boosting composition are that the antigen of the composition is the same antigen, or a cross-reactive antigen, as that encoded by the priming composition.

In another embodiment, the SAdV-36, SAdV-42.1, SAdV-42.2 and/or SAdV-44 vectors are also well suited for use in a variety of other immunization and therapeutic regimens. Such regimens may involve delivery of SAdV-36, SAdV-42.1, SAdV-42.2 and/or SAdV-44 vectors simultaneously or sequentially with Ad vectors of different serotype capsids, regimens in which SAdV-36, SAdV-42.1, SAdV-42.2 and/or SAdV-44 vectors are delivered simultaneously or sequentially with non-Ad vectors, and regimens in which the SAdV-36, SAdV-42.1, SAdV-42.2 and/or SAdV-44 vectors are delivered simultaneously or sequentially with proteins, peptides, and/or other biologically useful therapeutic or immunogenic compounds. Such uses will be readily apparent to one of skill in the art.

The following examples illustrate the cloning of SAdV-36, SAdV-42.1, SAdV-42.2 and SAdV-44 and the construction of exemplary recombinant vectors. These examples are illustrative only, and do not limit the scope of the present invention.

EXAMPLE 1

Isolation of Simian Adenovirus and PCR Analysis

A. Simian Adenovirus 36

Stool samples were recovered from the floors of the Michael E. Keeling Center for Comparative Medicine and Research, University of Texas M. D. Anderson Cancer Center) facility that houses the chimpanzees (*Pan troglodytes*) and were frozen and sent to University of Pennsylvania. The samples were thawed and suspended in Hanks' Balanced Salt solution, the particulates pelleted by centrifugation, and sterile filtered through 0.2 micron syringe filters. 100 μl of each filtered sample was inoculated into A549 cells grown in Ham's F12 with 10% FBS, 1% Penn-Strep and 50 μg/ml gentamicin. After about 1 to 2 weeks in culture, visual cytopathic effect (CPE) was obvious in cell cultures with several of the inocula. The presence of adenoviruses in the cultures was confirmed by PCR amplification of an internal 1.9 kb of the hexon—the region encompassing the hypervariable (HVR) regions and that is predominantly responsible for conferring serotype specificity. The primer pair that was utilized for PCR was CAGGATGCTTCGGAGTACCTGAG (SEQ ID NO:126) and TTGGCNGGDATDGGGTAVAG-CATGTT (SEQ ID NO:127). The sequence obtained from this region was used to make an initial determination of adenoviral species and novelty of the serotype. The sequence was determined to be in adenovirus subgroup E.

Adenoviral isolates that were determined to be novel were plaque purified on A549 cells, propagated to high titer and purified on cesium chloride gradients using standard procedures. Viral DNAs obtained from purified virus preparations were completely sequenced (Qiagen Genomics Services, Hilden, Germany).

A total of 25% (36/142) of the M.D. Anderson samples demonstrated cytopathology which in each case was confirmed by PCR to be due to the outgrowth of at least one adenovirus; the assay is based on amplification of a portion of the hexon gene that spans hypervariable regions 1 to 6[L. Crawford-Miksza, et al, *J Virol* 70, 1836 (March 1996)].

B. Simian Adenovirus 42.1 (Previously Named SAdV-42)

Stool samples were recovered from the floors of the San Diego zoo that houses bonobo apes [*Pan paniscus*)], were frozen and sent to University of Pennsylvania. The samples were thawed and suspended in Hanks' Balanced Salt solution, the particulates pelleted by centrifugation, and sterile filtered through 0.2 micron syringe filters. 100 μl of each filtered sample was inoculated into A549 cells grown in Ham's F12 with 10% FBS, 1% Penn-Strep and 50 μg/ml gentamicin. After about 1 to 2 weeks in culture, visual cytopathic effect (CPE) was obvious in cell cultures with several of the inocula. The presence of adenoviruses in the cultures was confirmed by PCR amplification of an internal 1.9 kb of the hexon—the region encompassing the hypervariable (HVR) regions and that is predominantly responsible for conferring serotype specificity. The primer pair that was utilized for PCR was CAGGATGCTTCGGAGTACCTGAG (SEQ ID NO:126) and TTGGCNGGDATDGGGTAVAG-CATGTT (SEQ ID NO:127). The sequence obtained from this region was used to make an initial determination of adenoviral species and novelty of the serotype. This isolate was determined to be in adenovirus subgroup C.

C. Simian Adenovirus 42.2 (Previously Named SAdV-43)

Stool samples were recovered from the floors of the Jacksonville, Fla. zoo that houses bonobo apes [*Pan paniscus*)], were frozen and sent to University of Pennsylvania. The samples were thawed and suspended in Hanks' Balanced Salt solution, the particulates pelleted by centrifugation, and sterile filtered through 0.2 micron syringe filters. 100 μof each filtered sample was inoculated into A549 cells grown in Ham's F12 with 10% FBS, 1% Penn-Strep and 50 μg/ml gentamicin. After about 1 to 2 weeks in culture, visual cytopathic effect (CPE) was obvious in cell cultures with several of the inocula. The presence of adenoviruses in the cultures was confirmed by PCR amplification of an internal 1.9 kb of the hexon—the region encompassing the hypervariable (HVR) regions and that is predominantly responsible for conferring serotype specificity. The primer pair that was utilized for PCR was CAGGATGCTTCGGAGTACCTGAG (SEQ ID NO:126) and TTGGCNGGDATDGGGTAVAG-CATGTT (SEQ ID NO:127), where "N" represents any amino acid. The sequence obtained from this region was used to make an initial determination of adenoviral species and novelty of the serotype. This isolate was determined to be in adenovirus subgroup C.

D. Simian Adenovirus 44

Stool samples were recovered from the floors of the Jacksonville, Fla. zoo that houses bonobo apes [*Pan paniscus*)], were frozen and sent to University of Pennsylvania. The samples were thawed and suspended in Hanks' Balanced Salt solution, the particulates pelleted by centrifugation, and sterile filtered through 0.2 micron syringe filters. 100 μl of each filtered sample was inoculated into A549 cells grown in Ham's F12 with 10% FBS, 1% Penn-Strep and 50 μg/ml gentamicin. After about 1 to 2 weeks in culture, visual cytopathic effect (CPE) was obvious in cell cultures with several of the inocula. The presence of adenoviruses in the cultures was confirmed by PCR amplification of an internal 1.9 kb of the hexon—the region encompassing the hypervariable (HVR) regions and that is predominantly responsible for conferring serotype specificity. The primer pair that was utilized for PCR was CAGGATGCTTCGGAGTACCTGAG (SEQ ID NO:126) and TTGGCNGGDATDGGGTAVAG-CATGTT (SEQ ID NO:127), where "N" represents any amino acid. The sequence obtained from this region was used to make an initial determination of adenoviral species and novelty of the serotype. This isolate was determined to be in adenovirus subgroup C.

EXAMPLE 2

Neutralizing Antibody (NAB) in Human Serum to Adenoviral Isolates

Serum samples from 50 normal human subjects (obtained from a blood bank) were tested for their ability to neutralize the ape adenovirus isolates. The prevalence and magnitude of human serum neutralizing antibody (NAB) responses to SAdV-36, SAdV-42.2 and SAdV-44 was determined.

Serum from each of the human subjects was serially diluted and the NAB titer for each of SAdV-36, SAdV-42.2 and SAdV-44 was determined. The frequency of seropositivity in samples having an NAB titer greater than or equal to 1/20 was determined for SAdV-36, SAdV-42.2, SAdV-44, along with controls SAdV-24 and HAdV-5.10% and 28% of samples (NAB greater than or equal to ½₀), were positive for SAdV-24 and HAdV-5, respectively. 82%, 97% and 68% of samples (NAB greater than or equal to 1/20) were positive for SAdV-36, SAdV-42.2 and SAdV-44, respectively.

Neutralization titers for samples having a NAB titer greater than or equal to ½₀ were plotted as the reciprocal of serum dilution, reflecting the breadth of the response and its distribution for that subset of samples. The median neutralizing antibody titers for SAdV-36, 42.2, and 44 were found to be more comparable to SAdV-24 than HAdV-5, i.e., they avoid pre-existing immunity in human serum.

EXAMPLE 3

Vector Construction

A. SAdV-36 (subgroup E)

An E1 deleted vector using the SAdV-36 (species E) DNA (SEQ ID NO:1) was prepared as described.

(i) Construction of pSR6

A linker containing SmaI, AscI, AvrII, EcoRV sites flanked by PacI sites is cloned into pBR322 cut with EcoRI and NdeI as follows. The oligomers pSR6 top AATTTTAATTAACCCGGGTATCG-GCGCGCCTTAACCTAGGGATAGATATCTT AATTAA (SEQ ID NO:128) and pSR6 bot
TATTAATTAAGATATCTATCCCTAGGT-
TAAGGCGCGCCGATACCCGGGTTAA TTAA (SEQ ID NO:129)
were annealed together to create the linker.

(ii) Cloning of the Viral Left End to the AscI Site (7959)

The viral DNA was digested with AscI and the 7958 bp left end fragment was cloned into pSR6 (prepared as in step (i)) digested with SmaI and AscI to yield pSR6 C36 LE.

(iii) E1 Functional Deletion and Insertion of I-CeuI and PI-SceI Sites

The plasmid pSR6 C36 LE (prepared as in step (ii)) was digested with SnaBI and NdeI; the NdeI site was filled in with Klenow. The EcoRV fragment from pBleuSK I-PI was ligated in to create pSR5 C36 LE IP. This step causes a deletion of the SAdV-36 E1 genes. In place of the E1 deletion, the fragment that was ligated in harbors recognition sites for the extremely rare cutter restriction enzymes I-CeuI and PI-SceI respectively. This allows the subsequent insertion of transgene cassettes in place of the E1 deletion.

(iv) Cloning of the Viral Right End from the XbaI Site (30009)

The plasmid pSR6 C36 LE IP (prepared as in step (iii)) was digested with XbaI and EcoRV. The 6548 bp right end (XbaI digest) fragment from the SAdV-36 DNA was ligated in to create pC36 LE IP RE.

(v) Cloning of the Viral Middle XbaI Fragment (6040-30009)

The plasmid p36 LE IP RE (prepared as in step (iv)) was digested with XbaL The 23969 bp fragment from the SAdV-36 DNA was ligated in to create pC36 IP.

B. SAdV-42.1 (Subgroup C)

An E1 deleted vector using the SAdV-42.1 DNA (SEQ ID NO:33) may be prepared in the same manner as an SAdV-42.2 E1 deleted vector as described in part "C", below, or by the following method.

An E1 deleted vector using the SAdV-42.1 DNA (SEQ ID NO:33) may be prepared using methods which have been previously described. A linker containing SmaI, ClaI, XbaI, SpeI, EcoRV sites flanked by SwaI is cloned into pBR322 cut with EcoRI and NdeI (pSR5). Viral DNA is digested with XbaI and the 6 kb fragments (left and right ends) are gel purified and ligated into pSR5 digested with SmaI and XbaI 12 minipreps are diagnosed with SmaI and assessed for expected fragment sizes. Minipreps are sequenced to check the integrity of the viral DNA end. The sequence obtained is used to correct the left end Qiagen sequence and deduce the correct right ITR sequence as well. The plasmid is digested with SnaBI and NdeI and the NdeI site is filled in with Klenow. The EcoRV fragment from pBleuSK I-PI is ligated in. Minipreps are diagnosed using PstI. The resulting plasmid is digested with XbaI and EcoRV. The right end (XbaI digest) fragment from the SAdV-42.1 DNA is ligated in. Minipreps are diagnosed using ApaLI. The resulting plasmid is then digested with XbaI and EcoRV. The left end (XbaI digest) fragment from the SAdV-42.1 DNA is ligated in and minipreps are diagnosed using MfeI 293 cells are then transfected using manufacturer's protocol.

C. SAdV-42.2 (Subgroup C)

An E1 deleted vector using the SAdV-42.2 (subgroup C) DNA (SEQ ID NO:64) was prepared as described.

(i) Construction of pSR2

A linker containing SnaBI, FseI, MluI, PacI and, EcoRV sites flanked by PmeI sites was cloned into pBR322 cut with EcoRI and NdeI as follows. The oligomers P6 Top
AATTGTTTAAACTACGTAATTAGGCCG-
GCCGCGCACGCGTGTCATTAATTAA GCTA-
GATATCGTTTAAAC (SEQ ID NO:130) and P6 Bot
GTTTAAACGATATCTAGCTTAATTAAT-
GACACGCGTGCGCGGCCGGCCTAAT TACGTAGTT-
TAAACAT (SEQ ID NO:131) were annealed together to create the linker.

(ii) Construction of pSR7

The plasmid pSR2 (prepared as in step (i)) was digested with MluI and the annealed oligomers 951 top—CGCG-CATATGGATCGATCGCTAGCGATCGATCGAATTC (SEQ ID NO:132) and 951 bot—CGCGGAATTCGATC-GATCGCTAGCGATCGATCCATATG (SEQ ID NO:133) were ligated in. This creates a linker harboring SnaBI, FseI, NdeI, NheI, EcoRI, PacI and EcoRV sites flanked by PmeI sites. In pSR7, this linker replaces the pBR322 fragment from the EcoRI to the NdeI sites.

(iii) Cloning of the Viral Right End

The 826 bp right end fragment extending from the PacI site was cloned into pSR7 (prepared as in step (ii)) between the EcoRV and PacI sites, to yield pSR7 42.2 RE.

(iv) Construction of E1 Deleted Left End by PCR

A New England Biolabs (NEB) Phusion™ kit was used with each primer at 0.5 µM, dNTP at 0.2 mM each, NEB Phusion™ enzyme, and buffers (as supplied in kit). PCR conditions (for all three reactions) were 98° for 30 seconds, and 25 cycles of [98° for 10s, anneal for 30 seconds, 72° for 15 seconds].

PCR 1—The Oligomers 42.1—CATCATCAATAATATACCTTATTTTGG (SEQ ID NO:134) and 42.2—CCCAGATTACGTATAAAACG-
GAGACTTTGACCC (SEQ ID NO:135) were designed to amplify the first 451 bp of the SAdV-42.2 genomic DNA+10 bp overhang (template—SAdV-42.2 DNA, annealing at 61°:

(SEQ ID NO: 136)
CATCATCAATAATATACCTTATTTTGGATTGAAGCCAATATGATAAT

GAGGTGGGCGGAGCGGGCGGAGTTGGGAGGCGCGGGCGGGCGGC

GGCGCGGGCGGGCCGGGAGGTGTGGCGGAAGTTGAGTTTGTAAGTG

TGGCGGATGAGACTTGCTAGCGCCGGATGTGGTAAAAGTGACGTTTT

TGGAGTGCGACAACGCCCACGGGAAGTGACATTTTTCCCGCGGTTTT

TACCGGATGTCGTAGTGAATTTGGGCGTTACCAAGTAAGATTTGGCC

ATTTTCGCGGGAAAACTGAAATGGGGAAGTGAAATCTGATTAATTTC

GCGTTAGTCATACCGCGTAATATTTGCCGAGGGCCGAGGGACTTTGA

CCGATTACGTGGAGGAATCGCCCAGGTGTTTTTTGAGGTGAATTTCC

GCGTTCCGGGTCAAAGTCTCCGTTTTATACGTAATCTGGG

PCR 2—The Oligomers 42.3 (CGTTTTATACGTAATCTGGGCAACAG-GAGGGGT) (SEQ ID NO:137) and 42.4 (TCGGTCACATCCAGCATCAC) (SEQ ID NO:138) were designed to amplify a 242 bp fragment containing to the 229 bp fragment of SAdV-42.2 (3223 to 3451 bp of the SAdV-42.2 genome) and a 13 bp overhang harboring a SnaBI site.

(SEQ ID NO: 139)
CGTTTTATACGTAATCTGGGCAACAGGAGGGGTGTGTTCCTGCCCTA

TCAATGCAACTTGAGCCACACCAAGGTCTTGCTAGAGCCCGAAAGCA

TGTCCAAGGTGAACCTGAACGGGGTGTTTGACATGACCCTGAAGATA

TGGAAGGTGCTGAGGTACGACGAGACCAGGTCTCGGTGCAGGCCCTG

CGAGTGCGGGGCAAGCATATGAGGAACCAGCCTGTGATGCTGGATG

TGACCGA

There is a 20 bp sequence overlap between PCR 1 and PCR 2 that allows for polymerase chain reaction splicing by overlap extension (PCR SOEing). A SnaBI site is present at the junction of the two PCR fragments for insertion of foreign DNA in place of the functional E1 deletion.

PCR 3—To combine the products of PCR 1 and PCR 2, 20 μl of each PCR were run on a 1% SeaPlaque® gel. The bands were cut out and the agarose melted at 68°. 5 μl of each melted gel was combined with 190 μl of water. 4 μl of the diluted mixture was used as template in a 200 μl PCR reaction using the primers 42.1 and 42.4, annealing at 61°. The expected product size was 685 bp.

(v) Cloning of SAdV-42.2 Left End DNA Fragment Harboring a Functional E1 Deletion with Insertion of I-CeuI and PI-SceI Sites to Yield pSR7 C42.2 LE delE1 IP The final PCR product was digested with NdeI and ligated, into pSR7 42.2 RE (prepared as in step (iii)) cut with SnaBI and NdeI to yield pSR7 C42.2 LERE. This plasmid was digested with SnaBI and an EcoRV fragment from pBleuSK I-PI harboring I-CeuI and PI-SceI sites was ligated in, to yield pC42.2 LE delE1 IP.

(vi) Cloning of the SAdV-42 Viral Right End from the EcoRI Site (33952)

The SAdV-42.2 viral DNA was digested with EcoRI and the 3767 bp right end fragment was cloned into pSR7 C14 LE delE1 IP (prepared as in step (v)) between EcoRI and EcoRV to yield pC42.2IP LE RE.

(vii) Cloning of the SAdV-42.2 Viral Nde I (3416-19843) Fragment

The plasmid pC42.21P LE RE (prepared as in step (vi)) was digested with NdeI and the 16427 bp viral NdeI fragment was ligated in. The clone was called pC42.2 del Mlu Pac.

(viii) Cloning of the SAdV-42.2 Viral MluI (12534)—PacI (37000) Fragment

The plasmid pC42.2 del Mlu Pac (prepared as in step (vii)) was digested with MluI and PacI and the 24466 bp viral MluI-PacI fragment was ligated in. The clone was called pC42.2 IP and is a molecular clone of SAdV-42.2 genomic DNA harboring an E1 deletion and I-CeuI and PI-SceI recognition sites in place of the E1 deletion.

D. SAdV-44 (Subgroup C)

An E1 deleted vector using the SAdV-42.2 (subgroup C) DNA (SEQ ID NO: 95) was prepared as described.

(i) Construction of pSR2

A linker containing SnaBI, FseI, MluI, PacI and, EcoRV sites flanked by PmeI sites was cloned into pBR322 cut with EcoRI and NdeI as follows. The oligomers P6 Top
AATTGTTTAAACTACGTAATTAGGCCG-GCCGCGCACGCGTGTCATTAATTAA GCTA-GATATCGTTTAAAC (SEQ ID NO:130) and P6 Bot
GTTTAAACGATATCTAGCTTAATTAAT-GACACGCGTGCGCGGCCGGCCTAAT TACGTAGTT-TAAACAT (SEQ ID NO:131) were annealed together to create the linker.

(ii) Cloning of the viral left end by PCR

The left end (PCR, 480 bp+24 bp extension) was cloned into pSR2 between SnaBI and MluI using the following primers.

forward primer -
(SEQ ID NO: 134)
pCATCATCAATAATATACCTTATTTTGG reverse primer -
(SEQ ID NO: 140)
GATCACGCGTCATGCATGCATATGAATACACTCCGCGTCAGCTG The underlined bases in the reverse primer sequence correspond to recognition sites for MluI and NdeI respectively. This plasmid yielded was pSR2 C44 LE.

(iii) Cloning of the Viral Right End

The 821 bp right end fragment of SAdV-44 extending from the PacI site was cloned into pSR2 C44 LE (prepared as in step (ii)) between the EcoRV and PacI sites, to yield pSR2 44 LERE.

(iv) Cloning of the SAdV-44 Viral NdeI (3413) to MluI (12528) Fragment

The SAdV-44 viral DNA was digested with NdeI and MluI and the 9115 bp fragment was cloned into pSR2 44 LERE (prepared as in step (iii)) between NdeI and MluI to yield pSR2 C44 LERE-2.

(v) Cloning of the SAdV-44 Viral MluI (12528)—PacI (36891) Fragment

The plasmid pSR2 C44 LERE-2 (prepared as in step (iv)) was digested with MluI and PacI and the 24363 bp viral MluI-PacI fragment was ligated in. The clone was called pC44 IP and is a molecular clone of SAdV-44 genomic DNA harboring an E1 deletion and I-CeuI and PI-SceI recognition sites in place of the E1 deletion.

EXAMPLE 4

Insertion of Influenza A Nucleoprotein Expression Cassette

The nucleotide sequence encoding the H1N1 influenza A virus nucleoprotein (NP) (A/Puerto Rico/8/34/Mount Sinai, GenBank accession number AF389119.1) was codon optimized and completely synthesized (Celtek Genes, Nashville, Tenn.). An expression cassette (approximately 2.5 kb) composed of the human cytomegalovirus early promoter, an artificial intron derived from the Promega (Madison, Wis.) plasmid pCI, the codon optimized influenza A NP coding sequence and the bovine growth hormone polyadenylation signal was constructed in a shuttle plasmid.

The expression cassette was cut out with the restriction enzymes I-CeuI and PI-SceI and inserted into the plasmid SAdV-36, SAdV-42.2 and SAdV-44 molecular clones obtained as described in Example 3 (above). The resulting molecular clones (harboring the expression cassette for influenza nucleoprotein (NP)) were transfected into the E1 trans-complementing cell line HEK 293, and recombinant SAdV-36, SAdV-42.2 and SAdV-44 harboring the NP expression cassette were rescued. Adenovirus was purified by cesium chloride density gradient centrifugation and the particle titer determined by measuring absorbance at 260 and 280 nm.

EXAMPLE 5

T cell Induction By Recombinant SAdV-36 Expressing Influenza A Nucleoprotein (NP)

The protocols contained in Roy, et al. ["Partial protection against H5N1 influenza in mice with a single dose of a chimpanzee adenovirus vector expressing nucleoprotein", *Vaccine* 25:6845-6851 (Aug. 6, 2007)], which is herein incorporated by reference, were utilized in the following experiment.

A. Inoculation of Mice

BALB/c mice (6-8 weeks old) were purchased from Charles River Laboratories (Wilmington, Mass.). The chimpanzee adenovirus vectors C36 CMV PI FluA NP (prepared as described in Example 4) and the human HAdV-5 vector AdH5-FluA NP (prepared consistent with Example 4) were used to vaccinate BALB/c mice (5 mice per group). Mice were sedated with intra-peritoneal ketamine/xylazine, and the total adenovirus dose (1011 viral particles per mouse) divided into two 25 µl injections given intra-muscularly to the hind leg tibialis anterior.

B. Analysis of CD8+T Lymphocytes from Immunized BALB/C Mice

Vaccinated mice were sacrificed 10 days following immunization and their and their CD8+T cells were analyzed by stimulating with the immunodominant peptide TYQR-TRALV (SEQ ID NO:141) of influenza nucleoprotein and staining for the cytokines interferon gamma (IFN-γ), interleukin-2 (IL-2) and tumor necrosis factor-a (TNF-α). It was of interest to determine the subset of the CD8+T cells that were polyfunctional, i.e., capable of secreting multiple cytokines such as IL-2 and TNF-a, which may be an indication of the quality of the T cell response especially with respect to the formation of a memory population. Splenocytes from 5 mice per group were assayed. The results are shown in FIG. 1.

The vector based on SAdV-36 is similar to that based on HAdV-5 in its ability to elicit a T cell response against the vaccine immunogen (influenza A nucleoprotein).

All documents recited above are incorporated herein by reference. Numerous modifications and variations are included in the scope of the above-identified specification and are expected to be obvious to one of skill in the art. Such modifications and alterations to the compositions and processes, such as selections of different minigenes or selection or dosage of the vectors or immune modulators are believed to be within the scope of the claims appended hereto.

said capsid encapsidating a heterologous nucleic acid molecule carrying a gene sequence operably linked to expression control sequences which direct transcription, translation, or expression in a host cell.

2. The adenovirus according to claim 1, further comprising 5' and 3' adenovirus cis-elements necessary for replication and encapsidation.

3. The adenovirus according to claim 1, wherein said adenovirus lacks all or a part of the E1 gene.

4. The adenovirus according to claim 3, wherein said adenovirus is replication-defective.

5. The recombinant adenovirus according to claim 1, wherein said adenovirus is a pseudotyped adenovirus comprising 5' and 3' adenovirus cis-elements necessary for replication and encapsidation, said cis-elements comprising an adenovirus 5' inverted terminal repeat and an adenovirus 3' inverted terminal repeat.

6. The recombinant adenovirus according to claim 1, wherein the adenovirus comprises a nucleic acid sequence encoding a product operatively linked to sequences which direct expression of said product in a host cell.

7. The recombinant adenovirus according to claim 1, wherein the recombinant adenovirus comprises one or more adenovirus genes.

8. The recombinant adenovirus according to claim 1, wherein the recombinant adenovirus is replication-defective.

9. The recombinant adenovirus according to claim 8, wherein the recombinant adenovirus is deleted in adenovirus E1.

10. A composition comprising a recombinant adenovirus according to claim 1 comprising the hexon, penton, and fiber capsid proteins of SAdV-42.1, wherein said recombinant adenovirus further comprises one or more simian adenovirus proteins selected from the group consisting of:

E1a, SEQ ID NO: 61;
E1b, small T/19K, SEQ ID NO: 54;
E1b, large T/55K, SEQ ID NO: 34;
IX, SEQ ID NO: 35;
52/55D, SEQ ID NO: 36;

SEQUENCE LISTING (141 sequences)

SEQ ID NO: 1 - DNA, 36556 bp, Unknown
  Simian adenovirus 36
  repeat_region (1)..(124): label=ITR
  CDS (1903)..(3414): label=Elb\55K
  CDS (3502)..(3927): label=pIX
  misc_feature (3993)..(5614): label=IVa2   complement  (3993...5323,5602...5614)
  misc_feature (5096)..(13835): label=pol   complement  (5096...8656,13827...13835)
  misc_feature (8458)..(13835): label=pTP   complement  (8458...10380,13827...13835)
  CDS (10815)..(11996): label=52K
  CDS (12023)..(13798): label=pIIIa
  CDS (13880)..(15502): label=penton
  CDS (15509)..(16093): label=pVII
  CDS (16141)..(17175): label=V
  CDS (17201)..(17431): label=pX
  CDS (17507)..(18229): label=pVI
  CDS (18324)..(21146): label=hexon
  CDS (21173)..(21793): label=protease
  misc_feature (21881)..(23416): label=DBP   complement
  CDS (23439)..(25841): label=100K
  CDS (26467)..(27147): label=pVIII
  CDS (27151)..(27468): label=E3\12.5K
  CDS (28033)..(28566): label=E3\gp19K
  CDS (28600)..(29217): label=E3\CR1-beta
  CDS (29233)..(29844): label=E3\CR1-gamma
  CDS (29862)..(30743): label=E3\CR1-delta
  CDS (30754)..(31026): label=E3\RID\alpha
  CDS (31462)..(31866): label=E3\14.7K
  misc_feature (31873)..(32151): label=U\exon   complement
  CDS (32167)..(33441): label=fiber
  misc_feature (33557)..(34710): label=E4\orf\6/7   complement  (33557...33808,34540...34710)
  misc_feature (33808)..(34710): label=E4\orf6   complement
  misc_feature (34619)..(34981): label=E4\orf4   complement
  misc_feature (34994)..(35344): label=E4\orf3   complement
  misc_feature (35344)..(35730): label=E4\orf2   complement
  misc_feature (35773)..(36144): label=E4\orf1   complement
  repeat_region (36433)..(36556): label=ITR   complement
catcatcaataatatacctcaaacttttggtgcgcgttaatatgcaaatgagctgtttgaatttggggatgcggggctgtgattggctgtgggagcggcgaccgttaggggcggggcgggtgacgttttgatgacgtgtttgtgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtatttttcacctaaatttccgcgtacggtgtcaaagtccggtgtttttacgtaggcgtcagctgatcgccagggtatttaaacctgcgctctctagtcaagaggccactcttgagtgccagcgagtagagttttctcatccgcgccgcgagtcagatctacactttgaaagatgaggcacctgagagacctgcccggtaatgttttcctggctactgggaacgagattctggaactggtggtggacgccatgatgggtgacgaccctcctgagccccataccccatttgaggcgccttcgctgtacgatttgtatgatctggaggtggatgtgcccgagaacgaccccaacgaggaggcggtgaatgatttgtttagcgatgccgcgctgctggctgccgagcaggctaatacggactctggctcagacagcgattcctctctccataccccgagacccggcagaggtgagaaaaagatccccgagcttaaaggggaagagcttgacctgcgctgctatgaggaatgcttgcctccgagcgatgatgaggaggacgaggaggcgattcgagctgcagcgaaccagggagtgaaagcagcgagcgagggctttagcctggactgtcctactctgcccggacacggctgtaagtcttgtgaatttcatcgcatgaatactggagataagaatgtgatgtgtgccctgtgctatatgagagcttacaaccattgtgtttacagtaagtgtgattaactttagttgggaaggcagagggtgactgggtgctgactggtttatttatgtatatgttttttatgtgtaggtcccgtctctgacgcagatgagacccccacttcagagtgcatttcatcacccccagaaattggcgaggaaccgcccgaagatattattcatagaccagttgcagtgagagtcaccgggcggagagcagctgtggagagtttggatgacttgctacagggtggggatgaacctttggacttgtgtacccggaaacgccccaggcactaagtgccacacatgtgtgtttacttaaggtgatgtcagtatttatagggtgtggagtgcaataaaatccgtgttgactttaagtgcgtgttttatgactcaggggtgggactgtgggtatataagcaggtgcagacctgtgtggtcagttcagagcaggactcatggagatctggactgtcttggaagactttcaccagactagacagctgctagagaactcatcggagggagtctcttacctgtggagattctgcttcggtgggcctctagctaagctagtctatagggccaaacaggattataaggatcaatttgaggatattttgagagagtgtcctggtatttttgactctctcaacttgggccatcagtctcactttaaccagagtattctgagagcccttgacttttctactcctggcagaactaccgccgcggtagccttttttgcctttatccttgacaaatggagtcaagaaacccatttcagcagggattaccgtctggactgcttagcagtagctttgtggagaacatggaggtgccagcgcctgaatgcaatctccggctacttgccagtacagccggtagacacgctgaggatcctgagtctccagtcaccccaggaacaccaacgccgccagcagccgcagcaggagcagcagcaagaggaggaggaggaccgagaagagaacccgagagccggtctggaccctccggtggcggaggaggaggagtagctgacttgtttcccgagctgcgccgggtgctgactaggtcttccagtggacgggagagggggattaagcgggagaggcatgaggagactagccacagaactgaactgactgtcagtctgatgagccgcaggcgcccagaatcggtgtggtggcatgaggtgcagtcgcaggggatagatgaggtctcagtgatgcatgagaaatattccctagaacaagtcaagacttgttggttggagcccgaggatgattgggaggtagccatcaggaattatgccaagctggctctgaagccagacaagaagtacaagattaccaaactgattaatatcagaaattcctgctacatttcagggaatggggccgaggtggagatcagtacccaggagagggcggccttcagatgttgtatgatgaatatgtacccgggggtggtgggcatggagggagtcacctttatgaacacgaggttcaggggtgatgggtataatggggtggtctttatggccaacaccaagctgacagtgcacggatgctccttctttggcttcaataacatgtgcatcgaggcctggggcagtgtttcagtgaggggatgcagcttttcagccaactggatgggggtcgtgggcagaaccaagagcgtggtttcagtgaagaaatgtctgttcgagaggtgccacctgggggtgatgagcgagggcgaagccaaagtcaaacactgcgcctctaccgagacgggctgctttgtgctgatcaagggcaatgccaaagtcaagcataacatgatctgtggggcctcggatgagcgcggctaccagatgctgacctgcgccggtgggaacagccatatgctggccaccgtgcatgtggcctcgcacccccgcaagacatggcccgagttcgagcacaacgtcatgacccgatgcaacgtgcacctgggctcccgccgaggcatgttcatgccctaccagtgcaacatgcaatttgtgaaggtgctgctggagcccgatgccatgtccagagtgagcctgacgggggtgtttgacatgaatgtggagctgtggaaaattctgagatatgatgaatccaagaccaggtgccgggcctgcgaatgcggaggcaagcacgccaggcttcagcccgtgtgtgtggaggtgacggaggacctgcgacccgatcatttggtgttgtcctgcaacgggacggagttcggctccagcggggaagaatctgactagagtgagtagtgtttggggctgggtgggagtctgcatgatgggcagaatgactaaaatctgtgtttttctgtgtgttgcagcagcatgagcggaagcgcctcctttgagggaggggtattcagcccttatctgacggggcgtctcccctcctgggcgggagtgcgtcagaatgtgatgggatccacggtggacggccggcccgtgcagcccgcaaactcttcaaccctgacctacgcgaccctgagctcctcgtccgtggacgcagctgccgccgcagctgctgcttccgccgccagcgccgtgcgcggaatggccctgggcgccggctactacagctctctggtggccaactcgagttccaccaataatcccgccagcctgaacgaggagaagctgttgctgctgatggcccagctcgaggctctgacccagcgcctgggcgagctgacccagcaggtggctcagctgcaggcggagacgcgggccgcggttgccacggtgaaaaccaaataaaaaatgaatcaataaataaacggagacggttgttgattttaacacagagtcttgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttggtgtaggtgtttacaaatctgttgagctgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcccttgtgcccgcccaggttttccatgcactcatccatgatgatggcgatgggcccgtgggcggcggcctgggcaaagacgtttcgggggtcggacacatcatagttgtggtcctgggtgagctcgtcataggccattttaatgaatttggggcggagggtgcccgactgggggacgaaggtgccctcgatcccgggggcgtagttgccctcgcagatctgcatctcccaggccttgagctcggagggggggatcatgtccacctgcggggcgatgaaaaaaacggtttccggggcgggggagatgagctgggccgaaagcaggttccggagcagctgggacttgccgcagccggtgggaccgtagatgaccccgatgaccggctgcaggtggtagttgagggagagacagctgccgtcctcgcggaggaggggggccacctcgttcatcatctcgcgcacatgcatgttctcgcgcacgagttccgccaggaggcgctcgccccccagcgagaggagctcttgcagcgaggcgaagtttttcagcggcttgagcccgtcggccatgggcattttggagagggtctgttgcaagagttccagacggtcccagagctcggtgatgtgctctagggcatctcgatccagcagacctcctcgtttcgcgggttggggcgactgcgggagtagggcaccaggcgatgggcgtccagcgaggccagggtccggtccttccaggggcgcagggtccgcgtcagcgtggtctccgtcacggtgaaggggtgcgcgccgggctgggcgcttgcgagggtgcgcttcaggctcatccggctggtcgagaaccgctcccggtcggcgccctgcgcgtcggccaggtagcaattgagcatgagttcgtagttgagcgcctcggccgcgtggcccttggcgcggagcttacctttggaagtgtgtccgcagacgggacagaggagggacttgagggcgtagagcttgggggcgaggaagacggactcgggggcgtaggcgtccgcgccgcagctggcgcagacggtctcgcactccacgagccaggtgaggtcggggcggtcggggtcaaaaacgaggtttcctccgtgctttttgatgcgtttcttacctctggtctccatgagttcgtgtccccgctgggtgacaaagaggctgtccgtgtccccgtagaccgactttatgggccggtcctcgagcggggtgccgcggtcctcgtcgtagaggaaccccgcccactccgagacgaaggcccgggtccaggccagcacgaaggaggccacgtgggaggggtagcggtcgttgtccaccagcgggtccaccttctccagggtatgcaagcacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccgttggagacgcctttcatgagcccctcgtccatctggtcagaaaagacgatctttttgttgtcgagcttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggtgagctcgtcgggcacgattctgacccgccagccgcggttgtgcagggtgatgaggtccacgctggtggccacctcgccgcgcaggggctcgttggtccagcagaggcgcccgcccttgcgcgagcagaaggggggcagcgggtccagcatgagctcgtcgggggggtcggcgtccacggtgaagatgccgggcaggagctcggggtcgaagtagctgatgcaggtgcccagatcgtccagcgccgcttgccagtcgcgcacggccagcgcgcgctcgtaggggctgaggggcatgccccagggcatggggtgcgtgagcgcagaggcgtacatgccgcagatgtcgtagacgtagaggggctcctcgaggacgccgatgtaggtggggtagcagcgccccccgcggatgctggcgcgcacgtagtcgtacagctcgtgcgagggcgcgaggagccccgcgccgaggttggagcgctgcggcttttcggcgcggtagacgatctggcggaagatggcgtgggagttggaggagatggtgggcctctggaagatgttgaagtgggcgtggggcaggccgaccgagtccctgatgaagtgggcgtaggagtcctgcagcttggcgacgagctcggcggtgacgaggacgtccagggcgcagtagtcgagggtctcttggatgatgtcgtacttgagctggcccttctgcttccacagctcgcggttgagaaggaactcttcgcggtccttccagtactcttcgagggggaacccgtcctgatcggcacggtaagagcccaccatgtagaactggttgacggccttgtaggcgcagcagcccttctccacggggagggcgtaagcttgcgcggccttgcgcagggaggtgtgggtgagggcgaaggtgtcgcgcaccatgaccttgaggaactggtgcttgaagtcgaggtcgtcgcagccgccctgctcccagagctggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaagccgttgatgttgtggcccacgatgtagagttccacgaaccgtgggcggcccttgacgtggggcagcttcttgagctcctcgtaggtgagctcgtcagggtcgctgagcccgtgctgctcgagggcccagtcggcgagatggtggttggcgcggaggaaggaagtccagagatccacggccagggcggtttgcagacggtcccggtactgacggaactgctggccgacggccattttttcgggggtgacgcagtagaaggtgcgggggtccccgtgccagcgatcccatttgagctggagggcgagatcgagggcgagctcgacgaggcggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccgttggtggcgacgtcgatggcttgcagggtcccgtgcccctggggagtgaccaccgtcccccgtttcttcttgggcgctgcttccatgccggtcagaagcggcggcgaggacgcgcgccgggcggcagaggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccaagcgttccatggcctcgtaaaagtccacggcgaagttgaaaaactgggagttgcgcgccgagacggtcaactcctcctccagaagacggatgagctcggcgatggtggcgcgcacctcgcgctcgaaggccccgggaacctcttcttccatctcctcttcttcctcttccactaacatctcttctacttcctcctcaggcggtggcgggggagggggcctgcgtcgccggcggcgcacgggcagacggtcgatgaagcgctcgatggtctcgccgcgccggcgtcgcatggtctcggtgacggcccgcccgtcctcgcggggccgcagcgtgaagacgccgccgcgcatttccaggtggccgggggggtccccgttgggcagggagagggcgctgacgatgcatcttatcaattgccccgtagggactccgcgcaaggacctgagcgtctcgagatccacgggatctgaaaaccgttgaacgaaggcttcgagccagtcgcagtcgcaaggtaggctgagcacggtttcttctggcgggtcatgttggggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccagatccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcctgctggatctgggtgagggtggtctggaagtcgtcaaagtcgacgaagcggtggtaggctccggtgttgatggtgtaggagcagttggccatgacggaccagttgacggtctggtggccgggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgcaccaaccctccaggatacggaggcgggtcgtttttgcaactttttttcggaggccggaaatgaagactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagacccctagccagccgacttctccagttacggagcgagcccctcttttgttttttgtttttgccagatgcatcccgtactgcggcagatgcgcccccaccaccctccaccgcaacaacagccccctcctccacagccggcgcttctgcccccgccccagcagcagcagcaacttccagccacgaccgccgcggccgccgtgagcggggctggacagacttctcagtatgatcacctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaggcgttcagggaggcgctgctaaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgagcggtgagcgccagcaggcggcgcgagctgagcgaccaggagctgatgcacagcctgcagcgggccctgaccggggccgggaccgagggggagagctactttgacatgggcgcggacctgcactggcaacccagccgccgggccttggaggcggcggcaggaccctacgtagaagaggtggacgatgaggtggacgagggcgagtacctggaagactgatggcgcgaccgtatttttgctagatgcaacaacagccaccgcctcctgatcccgcgatgcgggcggcgctgcagagccagccgtccggcattaactcctcggacgattggacccaggccatgcaacgcatcatggcgctgacgacccgcaatcccgaagcctttagacagcagcctcaggccaaccggctctcggccatcctggaggccgtggtgccctcgcgctcgaaccccacgcacgagaaggtgctggccatcgtgaacgcgctggtggagaacaaggccatccgcggcgacgaggccgggctggtgtacaacgcgctgctggagcgcgtggcccgctacaacagcaccaacgtgcagaccaacctggacaggatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggcgttcaagaacttgcagggcctgtggggcgtgcaggccccggtcggggaccgcgcgacggtgtcgagcctgctgacgccgaactcgcgcctgctgctgctgctggtggcccccttcacggacagcggcagtatcaaccgcaactcgtacctgggctacctgattaacctgtaccgcgaggccatcggccaggcgcacgtggacgagcagacctaccaggagatcacccacgtgagccgcgccctgggccaggacgacccgggcaatctggaagccaccctgaactttttgctgaccaaccggtcgcagaagatcccgccccagtacgcgctcagcgccgaggaggagcgcatcctgcgatacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctaaacccccactggctaccgccgccggggttctacacgggcgagtacgacatgcccgaccccaatgacgggttcctgtgggacgatgtggacagcagcgtgttttccccccgaccgggtgctaacgagcgccccttgtggaagaaggaaggcagcgaccgacgcccgtcctcggcgctgtccggccgcgagggtgctgccgcggcggtgcccgaggccgccagtccttttcctagcttgcccttctcgctgaacagtattcgcagcagcgagctgggcaggatcacgcgcccgcgcttgctcggcgaggaggagtacttgaatgactcgctgttgagacccgagcgggagaagaacttccccaataacgggatagagagcctggtggacaagatgagccgctggaagacgtacgcgcaggagcacagggacgatccgtcgcagggggccacgagccggggcagcgccgcccgtaaacgccggtggcacgacaggcagcggggactgatgtgggacgatgaggattccgccgacgacagcagcgtgttggacttgggtgggagtggtggtggtaacccgttcgctcacctgcgcccccgcatcgggcgcatgatgtaagaaaccgaaaataaatgatactcaccaaggccatggcgaccagcgtgcgttcgtttcttctctgttgttgtatctagtatgatgaggcgtgcgtacccggagggtcctcctccctcgtacgagagcgtgatgcagcaggcgatggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgaattcatgtacagcaacaagttcaaggcgcgggtcatggtctcccgcaagacccccaatggggtcaaagtagatgaaaattatgatggtagtcaggatgagctgaaatacgagtgggtggagtttgagctgcccgaaggcaacttctcggtgaccatgaccatcgacctgatgaacaacgccatcatcgacaattacttggcggtggggcggcagaacggggtcctggaaagcgacatcggcgtgaagttcgacactaggaacttcaggctgggctgggaccccgtgaccgagctggtcatgcccggggtgtacaccaacgaggccttccatcccgatgttgtcttgctgcccggctgcggggtggactttaccgagagccgcctcagcaacctgctgggcattcgcaagaggcagcccttccaggagggattccagatcatgtacgaggatctggaggggggcaacatccccgcgctcctggatgtcgaggcctatgaggaaagcaaggaaaaagctgaagccgaggcgactgcagccgtggctaccgccgcgaccaccaatgcagatgcaactaccaccagaggcgatacattcgccactgtggcggaggaagcagccgccctagcggtcgccgatgatagtgaaagtaagatagttatcaagccagtaaaagtggatagcaagaacagaagctacaacgtgctgccggacgaggtaaacaccgcctaccgcagctggtacctggcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggtcgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcagccagacgcgcggcctccggcagcagcagcagcgccggcaggacccgcagacgcgcggccacggcggcggcggcggccatcgccagcatgtcccgcccgcggcgcggcaacgtgtactgggtgcgcgacgccgccaccggtgtgcgcgtgcccgtgcgcacccgcccccctcgcacttgaagatgctgacttcgcgatgttgatgtgtcccagcggcgaggaggatgtccaagcgcaaatacaaggaagagatgctccaggtcatcgcgcctgagatctacggccccgcggtgaaggaggaaagaaagccccgcaaactgaagcgggtcaaaaaggacaaaaaggaggaggaagatgtggatggactggtggagtttgtgcgcgagttcgccccccggcggcgcgtgcagtggcgcgggcggaaagtgaagccggtgctgcggccaggcaccacggtggtcttcacgcccggcgagcgttccggctccgcctccaagcgctcctacgacgaggtgtacggggacgaggacatcctcgagcaggcggccgagcgtctgggcgagtttgcttacggcaagcgcagccgccccgcgcccttgaaagaggaggcggtgtccatcccgctggaccacggcaaccccacgccgagcctgaagccggtgaccctgcagcaggtgctgccgagcgcggcgccgcgccggggcttcaagcgcgagggcggcgaggatctgtacccgaccatgcagctgatggtgcccaagcgccagaagctggaggacgtgctggagcacatgaaggtggaccccgaggtgcagcccgaggtcaaggtgcggcccatcaagcaggtggccccgggcctgggcgtgcagaccgtggacatcaagatccccacggagcccatggaaacgcagaccgagcccgtgaagcccagcaccagcaccatggaggtgcagacggatccctggatgccggcgcccgcggcttccaccgccacccgccgaagacgcaagtacggcgcggccagcctgctgatgcccaactacgcgctgcatccttccatcatccccacgccgggctaccgcggcacgcgcttctaccgcggctacaccagccgccgccgcaagaccaccacccgccgccgccgtcgtcgcagccgccgcagcagcaccgcgacttccgccttggtgcggagagtgtatcgcagcgggcgcgagcctctgaccctgccgcgcgcgcgctaccacccgagcatcgccatttaactaccgcctcctacttgcagatatggccctcacatgccgcctccgcgtccccattacgggctaccgaggaagaaagccgcgccgtagaaggctgacggggaacgggctgcgtcgccatcaccaccggcggcggcgcgccatcagcaagcggttggggggaggcttcctgcccgcgctgatccccatcatcgccgcggcgatcggggcgatccccggcatagcttccgtggcggtgcaggcctctcagcgccactgagacacaaaaaaagcatggatttgtaataaaaaaatggactgacgctcctggtcctgtgatgtgtgtttttagatggaagacatcaatttttcgtccctggcaccgcgacacggcacgcggccgtttatgggcacctggagcgacatcggcaacagccaactgaacgggggcgccttcaattggagcagtctctggagcgggcttaagaatttcgggtccacgctcaaaacctatggcaacaaggcgtggaacagcagcacagggcaggcgctgagggaaaagctgaaagagcagaacttccagcagaaggtggtcgatggcctggcctcgggcatcaacggggtggtggacctggccaaccaggccgtgcagaaacagatcaacagccgcctggacgcggtcccgcccgcggggtccgtggagatgccccaggtggaggaggagctgcctcccctggacaagcgcggcgacaagcgaccgcgtcccgacgcggaggagacgctgctgacgcacacggacgagccgcccccgtacgaggaggcggtgaaactgggtctgcccaccacgcggcccgtggcgcctctggccaccggggtgctgaaacccagcagcagcagcagccagcccgcgaccctggacttgcctccgcctcgcccctccacagtggctaagcccctgccgccggtggccgtcgcgtcgcgcgccccccgaggccgcccccaggcgaactggcagagcactctgaacagcatcgtgggtctgggagtgcagagtgtgaagcgccgccgctgctattaaaagacactgtagcgcttaacttgcttgtctgtgtgtgtatatgtatgtccgccgaccagaaggaggaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcggggccccagtttcaaaccctactccggcaccgcctacaacagcctggctcccaagggagcgcccaacacctcacagtggaaggattccgacagcaaaatgcatacttttggagttgctgccatgcccggtgttgttggtaaaaaaatagaagccgatggtctgcctattggaatagattcatcctctggaactgataccataatttatgctgataaaactttccaaccagagccacaggttggaagtgacagttgggtcgacaccaatggtgcagaggaaaaatatggaggtagagctcttaaggacactacaaacatgaagccctgctacggttcttttgccaggcctaccaacaaagaaggtgggcaggctaacataaaagattctgaaactgccagcactactcctaactatgatatagatttggcattctttgacagcaaaaatattgccgctaactatgatccagatattgtaatgtacacagaaaatgttgagttgcaaactccagatactcatattgtgtttaagccaggaacttcagatgaaagttcagaagccaatttgggccagcaggccatgcccaacagacccaactacatcgggttcagagacaactttatcgggctcatgtactacaacagcactggcaatatgggtgtactggctggtcaggcctcccagctgaatgctgtggtggacttgcaggacagaaacaccgaactgtcctaccagctcttgcttgactctctgggtgacagaaccaggtatttcagtatgtggaatcaggcggtggacagctatgaccccgatgtgcgcattattgaaaatcacggtgtggaggatgaactccccaattattgcttccctttgaatggtgtgggctttacagatacttaccagggtgttaaagttaagacagatacagccgctgctggtaccaatggaacgcagtgggacaaagatgataccacagtcagcactgccaatgagatccactcaggcaatcctttcgccatggagatcaacatccaggccaacctgtggcggaacttcctctacgcgaacgtggcgctgtacctgcccgactcctacaagtacacgccggccaacatcacgctgccggccaacaccaacacctacgattacatgaacggccgcgtggtggcgccctcgctggtggacgcctacatcaacatcggggcgcgctggtcgctggaccccatggacaacgtcaaccccttcaaccaccaccgcaacgcgggcctgcgctaccgctccatgctcctgggcaacgggcgctacgtgcccttccacatccaggtgccccaaaagtttttcgccatcaagagcctcctgctcctgcccgggtcctacacctacgagtggaacttccgcaaggacgtcaacatgatcctgcagagctccctcggcaacgacctgcgcacggacggggcctccatcgccttcaccagcatcaacctctacgccaccttcttccccatggcgcacaacaccgcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggatggtccttcacgcgcctcaagacccgcgagacgccctcgctcggctccgggttcgacccctacttcgtctactcgggctccatcccctacctcgacggcaccttctacctcaaccacaccttcaagaaggtctccatcaccttcgactcctccgtcagctggcccggcaacgaccgcctcctgacgcccaacgagttcgaaatcaagcgcaccgtcgacggagaggggtacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtcgtggacgaggtcaactacaaggactaccaggccgtcaccctggcctaccagcacaacaactcgggcttcgtcggctacctcgcgcccaccatgcgccagggacagccctaccccgccaactacccctacccgctcatcggcaagagcgccgtcgccagcgtcacccagaaaaagttcctctgcgaccgggtcatgtggcgcatccccttctccagcaacttcatgtccatgggcgcgctcaccgacctcggccagaacatgctctacgccaactccgcccacgcgctagacatgaatttcgaagtcgaccccatggatgagtccacccttctctatgttgtcttcgaagtcttcgacgttgtccgagtgcaccagccccaccgcggcgtcatcgaggccgtctacctgcgcacgcccttctcggccggcaacgccaccacctaagccccgctcttgcttcttgcaagatgacggcctgtggctccggcgagcaggagctcagggccatcctccgcgacctgggctgcgggccctacttcctgggcaccttcgacaagcgcttcccgggattcatggccccgcacaagctggcctgcgccatcgtcaacacggccggccgcgagaccgggggcgagcactggctggccttcgcctggaacccgcgctcccacacctgctacctcttcgaccccttcgggttctcggacgagcgcctcaagcagatctaccagttcgagtacgagggcctgctgcgtcgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaacgcccactccgtctactttcgctcccaccgcgcgcgcatcgagaaggccaccgccttcgaccgcatgaatcaagacatgtaaactgtgtgtgtatgtgaatgctttattcatcataataaacagcacatgtttatgccaccttctctgaggctctgactttatttagaaatcgaaggggttctgccggctctcggcgtgccccgcgggcagggatacgttgcggaactggtacttgggcagccacttgaactcggggatcagcagcttcggcacggggaggtcggggaacgagtcgctccacagcttgcgcgtgagttgcagggcgcccagcaggtcgggcgcggagatcttgaaatcgcagttgggacccgcgttctgcgcgcgagagttacggtacacggggttgcagcactggaacaccatcagggccgggtgcttcacgctcgccagcaccgtcgcgtcggtgatgccctccacgtccatatcctcggcgttggccatcccgaagggggtcatcttgcaggtctgccgccccatgctgggcacgcagccgggcttgtggttgcaatcgcagtgcagggggatcagcatcatctgggcctgctcggagctcatgcccgggtacatggccttcatgaaagcctccagctggcggaaggcctgctgcgccttgccgccctcggtgaagaagaccccgcaggacttgctagagaactggttggtggcgcagcccgcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcgtgtgctccttctggatcatcacggtcccgtgcaggcaccgcagcttgccctcggcctcggtgcagccgtgcagccacagcgcgcagccggtgcactcccagttcttgtgggcgatctgggagtgcgagtgcacgaagccctgcaggaagcggcccatcatcgtggtcagggtcttgttgctggtgaaggtcagcggaatgccgcggtgctcctcgttcacatacaggtggcagatgcggcggtacacctcgccctgctcgggcatcagctggaaggcggacttcaggtcgctctccacgcggtaccggtccatcagcagcgtcatcacttccatgcccttctcccaggccgagacgatcggcaggctcagggggttcttcaccgttgtcatcttagtcgccgccgccgaggtcagggggtcgttctcgtccagggtctcaaacactcgcttgccgtccttctcgatgatgcgcacggggggaaagctgaagcccacggccgccagctcctcctcggcctgcctttcgtcctcgctgtcctggctgatgtcttgcaaaggcacatgcttggtcttgcggggtttctttttgggcggcagaggcggcggcggagacgtgctgggcgagcgcgagttctcgctcaccacgactatttcttcttcttggccgtcgtccgagaccacgcggcggtaggcgtgcctcttctggggcagaggcggaggcgacgggctctcgcggttcggcgggcggctggcagagccccttccgcgttcgggggtgcgctcctggcggcgctgctctgactgacttcctccgcggccggccattgtgttctcctagggagcaagcatggagactcagccatcgtcgccaacatcgccatctgcccccgccgccgcagccgacgaaaaccagcagcagaatgaaagcttaaccgccccgccgcccagccccacctccgacgccgcggccccagacatgcaagagatggaggaatccatcgagattgacctgggctacgtgacgcccgcggagcacgaggaggagctggcagcgcgcttttcagccccggaagagaaccaccaagagcagccagagcaggaagcagagagcgagcagcagcaggctgggctcgagcatggcgactacctgagcggggcagaggacgtgctcatcaagcatctggcccgccaatgcatcatcgtcaaggacgcgctgctcgaccgcgccgaggtgcccctcagcgtggcggagctcagccgcgcctacgagcgcaacctcttctcgccgcgcgtgccccccaagcgccagcccaacggcacctgcgagcccaacccgcgcctcaacttctacccggtcttcgcggtgcccgaggccctggccacctaccacctctttttcaagaaccaaaggatccccgtctcctgccgcgccaaccgcacccgcgccgacgccctgctcaacctgggccccggcgcccgcctacctgatatcgcctccttggaagaggttcccaagatcttcgagggtctgggcagcgacgagactcgggccgcgaacgctctgcaaggaagcggagaggagcatgagcaccacagcgccctggtggagttggaaggcgacaacgcgcgcctggcggtgctcaagcgcacggtcgagctgacccacttcgcctacccggcgctcaacctgccccccaaggtcatgagcgccgtcatggaccaggtgctcatcaagcgcgcctcgcccctctccgaggacgagatgcaggaccccgagagctcggacgagggcaagcccgtggtcagcgacgagcagctggcgcgctggctgggagcgagtagcaccccccagagcctggaagagcggcgcaagctcatgatggccgtggtcctggtgaccgtggagctggagtgtctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcctgcacgagaaccgcctggggcagaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctcaaggccctgtggaccgggttcgacgagcgcaccaccgccgcggacctggccgacctcatcttccccgagcgcctgcggctgacgctgcgcaacgggctgcccgactttatgagccaaagcatgttgcaaaactttcgctctttcatcctcgaacgctccgggatcctgcccgccacctgctccgcactgccctcggacttcgtgccgctgaccttccgcgagtgccccccgccgctctggagccactgttacttgctgcgcctggccaactacctggcctaccactcggacgtgatcgaggacgtcagcggcgagggtctgctcgaatgccactgccgctgcaacctctgcacgccgcaccgctccctggcctgcaacccccagctgctgagcgaaacccagatcatcggcaccttcgagttgcaaggccccggcgagggcaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggccatcctggcccaattgcaagccatccagaaatcccgccaagaatttctgctgaaaaagggccacggggtctacctggacccccagaccggagaggagctcaaccccagcttcccccaggatgccccgaggaagcagcaagaagctgaaagtggagctgccgctgccgccggaggatttggaggaagactgggagagcagtcaggcagaggaggaggagatggaagactgggacagcactcaggcagaggaggacagcctgcaagacagtctggaggaagacgaggtggaggaggaggcagaggaagaagcagccgccgccagaccgtcgtcctcggcggaggaggagaaagcaagcagcacggataccatctccgctccgggtcggggtcgcggcggccgggcccacagtaggtgggacgagaccgggcgcttcccgaaccccaccacccagaccggtaagaaggagcggcagggatacaagtcctggcgggggcacaaaaacgccatcgtctcctgcttgcaagcctgcgggggcaacatctccttcacccggcgctacctgctcttccaccgcggggtgaacttcccccgcaacatcttgcattactaccgtcacctccacagcccctactactgtttccaagaagaggcagaaacccagcagcagcagcagaaaaccagcggcagctagaaaatccacagcggcggcggcaggtggactgaggatcgcggcgaacgagccggcgcagacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccacacacggaaaaaggcgggaattacgtcaccacctgcgcccttcgcccgaccatcatcatgagcaaagagattcccacgccttacatgtggagctaccagccccagatgggcctggccgccggcgccgcccaggactactccacccgcatgaactggctcagtgccgggcccgcgatgatctcacgggtgaatgacatccgcgcccaccgaaaccagatactcctagaacagtcagcgatcaccgccacgccccgccatcaccttaatccgcgtaattggcccgccgccctggtgtaccaggaaattccccagcccacgaccgtactacttccgcgagacgcccaggccgaagtccagctgactaactcaggtgtccagctggccggcggcgccgccctgtgtcgtcaccgccccgctcagggtataaagcggctggtgatccgaggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggtggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcagctgacctagctcggcttcgacacctggaccactgccgccgcttccgctgcttcgctcgggatctcgccgagtttgcctactttgagctgcccgaggagcaccctcagggcccggcccacggagtgcggatcgtcgtcgaagggggcctcgactcccacctgcttcggatcttcagccagcgtccgatcctggtcgagcgcgagcaaggacatacccgtctgaccctgtactgcatctgcaaccaccccggcctgcatgaaagtctttgttgtctgctgtgtactgagtataataaaagctgagatcagcgactactccggacttccgtgtgttcctgaatccatcaaccagtctttgttcttcaccgggaacgagaccgagctccagctccagtgtaagccccacaagaagtacctcacctggctgttccagggctccccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcgccgctccccgctactaacaaccaaactacccaccaacgccgccgtcgcgacctttctgaatctaatactaccacccacaccggaggtgagctccgaggtcgaccaacctctgggatttactacggcccctgggaggtggtagggttaatagcgctaggcctagttgcgggtgggcttttggctctctgctacctatacctcccttgctgttcgtacttagtggtgctgtgttgctggtttaagaaatggggaagatcaccctagtgagctgcggtgtgctggtggcggtggtggtgctttcgattgtgggactgggcggcgcggctgtagtgaaggaggagaaggccgatccctgcttgcatttcaatcccgacaaatgccagctgagttttcagcccgatggcaatcggtgcacggtgctgattaagtgcggatgggaatgcgagaacgtgagaatcgagtacaataacaagactcggaacaatactctcgcgtccgtgtggcagcccggggaccccgagtggtacaccgtctctgtccccggtgctgacggctccccgcgcaccgtgaataatactttcatttttgcacacatgtgcgacacggtcatgtggatgagcaagcagtacgatatgtggccccccacgaaggagaacatcgtggtcttctccatcgcttacagcctgtgcacggcgctaatcaccgctatcgtgtgcctgagcattaacatgttcatcgctattcgccccagaaataatgccgaaaaagagaaacagccataacacgtttttttcacacacctttttcagaccatggcctctgttaaatttttgcttttatttgccagtctcattgccgtcattcatggaatgagtaatgagaaaattactatttacactggcactaatcacacattgaaaggtccagaaaaagccacagaagtttcatggtattgttattttaatgaatcagatgtatctactgaactctgtggaaacaataacaaaaaaaatgagagcattactctcatcaagtttcaatgtggatctgacttaaccctaattaacatcactagagactatgtaggtatgtattatggaactacagcaggcattttggacatggaattttatcaagtttctgtgtctgaacccaccacgcctagaatgaccacaaccacaaaaactacacctgttaccactatacagctcactaccaatggctttcttgccatgcttcaagtggctgaaaatagcaccagcattcaacccaccccacccagtgaggaaattcccagatccatgattggcattattgttgctgtagtggtgtgcatgttgatcatcgccttgtgcatggtgtactatgccttctgctacagaaagcacagactgaacgacaagctggaacacttactaagtgttgaattttaattttttagaaccatgaagatcctaggccttttaattttttctatcattacctctgctctatgcaattctgacaatgaggacgttactgtcgttgtcggatcaaattatacactgaaaggtccagcgaagggtatgctttcgtggtattgctattttggatctgacactacagaaactgaattatgcaatcttaagaatggcaaaattcaaaattctaaaattaacaattatatatgcaatggtactgatctgatactcctcaatatcacgaaatcatatgctggcagttacacctgccctggagatgatgctgacagtatgattttttacaaagtaactgttgttgatcccactactccacctccacccaccacaactactcacaccacacacacagatcaaaccgcagcagaggaggcagcaaagttagccttgcaggtccaagacagttcatttgttggcattacccctacacctgatcagcggtgtccggggttgctcgtcagcggtattgtcggtgtgctttcgggattagcagtcataatcatctgcatgttcatttttgcttgctgctatagaaggctttaccgacaaaaatcagacccactgctgaacctctatgtttaattttttccagagccatgaaggcagttagcgctctagttttttgttctttgattggcattgtttttagtgctgggtttttgaaaaatcttaccatttatgaaggtgagaatgccactctagtgggcatcagtggtcaaaatgtcagctggctaaaataccatctagatgggtggaaagacatttgcgattggaatgtcactgtgtatacatgtaatggagttaacctcaccattactaatgccacccaagatcagaatggtaggtttaagggccagagtttcactagaaataatgggtatgaatcccataacatgtttatctatgacgtcactgtcatcagaaatgagactgccaccacacagatgcccactacacacagttctaccactactaccatgcaaaccacacagacaaccactacatcaactcagcatatgaccaccactacagcagcaaagccaagtagcgcagcgcctcagccacaggctttggctttgaaagctgcgcaagctagtacaactactaggaccaatgagcagactactgattttttgtccactgtcgagagccacaccacagctacctcgagtgccttctctagcaccgccaatctctcctcgctttcctctacaccaatcagtcccgctactactcctagccccgctcatcttcccactcccctgaagcaaactgaggacagcggcatgcaatggcagatcaccctgctcattgtgatcgggttggtcatcctggccgtgttgctctactacatcttctgccgccgcattcccaacgcgcaccgcaagccggtctacaagcccatcattgtcgggcagccggagccgcttcaggtggaagggggtctaaggaatcttctcttctcttttacagtatggtgattgaactatgattcctagacaattcttgatcactattcttatctgcctcctccaagtctgtgccaccctcgctctggtggccaacgccagtccagactgtattgggcccttcgcctcctacgtgctctttgccttcatcacctgcatctgctgctgtagcatagtctgcctgcttatcaccttcttccagttcattgactggatctttgtgcgcatcgcctacctgcgccaccacccccagtaccacgaccagcgagtggcgcggctgctcaggctcctctgataagcatgcgggctctgctacttctcgcgcttctgctgttagtgctcccccgtcccgtcgacccccggtcccccactcagtcccccgaggaggttcgcaaatgcaaattccaagaaccctggaaattcctcaaatgctaccgccaaaaatcagacatgcatcccagctggatcatgatcattgggatcgtgaacattctggcctgcaccctcatctcctttgtgatttacccctgctttgactttggttggaactcgccagaggcgctctatctcccgcctgaacctgacacaccaccacagcagcaacctcaggcacacgcactaccaccaccacagcctaggccacaatacatgcccatattagactatgaggccgagccacagcgacccatgctccccgctattagttacttcaatctaaccggcggagatgactgacccactggccaacaacaacgtcaacgaccttctcctggacatggacggccgcgcctcggagcagcgactcgcccaacttcgcattcgccagcagcaggagagagccgtcaaggagctgcaggacggcatagccatccaccagtgcaagaaaggcatcttctgcctggtgaaacaggccaagatctcctacgaggtcactccaaatgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatcacccccttatccagtgaaataaagatcatattgatgatgatttaaataaaaaaataatcatttgatttgaaataaagatacaatcatattgatgatttgagtttaacaaaaaataaagaatcacttacttgaaatctgataccaggtctctgtccatgttttctgccaacaccacttcactcccctcttcccagctctggtactgcaggccccggcgggctgcaaacttcctccacacgctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggccgaccccgtcaccaccaagaacggggaaatcaccctcaagctgggagagggggtggacctcgactcctcgggaaaactcatctccaacacggccaccaaggccgccgcccctctcagtttttccaacaacaccatttcccttaacatggatcatcccttttacactaaagatggaaaattatccttacaagtttctccaccattaaatatactgagaacaagcattctaaacacactagctttaggttttggatcaggtttaggactccgtggctctgccttagcagtacagttagtctctccacttacatttgatactgatggaaacataaagcttaccttagacagaggtttgcatgttacaacaggagatgcaattgaaagcaacataagctgggctaaaggtttaaaatttgaagatggagccatagcaaccaacattggaaatgggttagagtttggaagcagtagtacagaaacaggtgttgatgatgcttacccaatccaagttaaacttggatctggccttagctttgacagtacaggagccataatggctggtaacaaagaagacgataaactcactttgtggacaacacctgatccatcaccaaactgtcaaatactcgcagaaaatgatgcaaaactaacactttgcttgactaaatgtggtagtcaaatactggccactgtgtcagtcttagttgtaggaagtggaaacctaaaccccattactggcaccgtaagcagtgctcaggtgtttctacgttttgatgcaaacggtgttcttttaacagaacattctacactaaaaaaatactgggggtataggcagggagatagcatagatggcactccatataccaatgctgtaggattcatgcccaatttaaaagcttatccaaagtcacaaagttctactactaaaaataatatagtagggcaagtatacatgaacggagatgtttcaaaacctatgcttctcactataaccctcaatggtactgatgacagcaacagtacatattcaatgtcattttcatacacctggactaatggaagctatgttggagcaacatttggggctaactcttataccttctcctacattgcccaagaatgaacactgtatcccaccctacattgcccaacccttcccaccccactctgtctatggaaaaaactctgaaacacaaaataaaataaagttcaagtgttttattgattcaacagttttacaggattcgagcagttatttttcctccaccctcccaagacatggaatacaccaccctctccccccgcacagccttgaacatttgaaagccattggtgatggacatgcttttggtctccacgttccacacagtttcagagcgagccagtctcgggtcggtcagggagatgaaaccctccgggcactcccgcatctgcacctcacagctcaacagctgaggattgtcctcggtggtcgggatcacggttatctggaagaagcagaagagcggcggtgggaatcatagtccgcaaacgggatcggccggtggtgtcgcatcaggccccgcagcagtcgctgccgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacaggaccaccaggttgtttaacagtccatagttcaacacgctccagccgaaactcatcgcgggaaggatgctacccacgtggccgtcgtaccagatcctcaggtaaatcaagtggcgctccctccagaacacgctgcccacgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccggcaatggcaatggaggacccaccgctcgtacccgtggatcatctgggagctgaacaagtctatgttggcacagcacaggcatatgctcatgcatctcttcagcactctcagctcctcgggggtcaaaaccatatcccagggcacggggaactcttgcaggacagcgaaccccgcagaacagggcaatcctcgcacataacttacattgtgcatggacagggtatcgcaatcaggcagcaccgggtgatcctccaccagggaagcgcgggtctcggtctcctcacagcgtggtaagggggccggccgatacgggtgatggcgggacgcggctgatcgtgttctcgaccgtgtcatgatgcagttgctttcggacattttcgtacttgctgtagcagaacctggtccgggcgctgcacaccgatcgccggcggcggtcccggcgcttggaacgctcggtgttgaagttgtaaaacagccactctcttagaccgtgcagcaaatctagggcctcaggagtgatgaagatcccatcatgcctgatagctctgatcacatcgaccaccgtggaatgggccagacccagccagatgatgcaattttgttgggtttcggtgacggcgggggagggaagaacaggaagaaccatgattaacttttaatccaaacggtctcggagcacttcaaaatgaaggtcgcggagatggcacctctcgcccccgctgtgttggtggaaaataacagccaggtcaaaggtgatacggttctcgagatgttccacggtggcttccagcaaagcctccacgcgcacatccagaaacaagacaatagcaaaagcgggagggttctctaattcctcaatcatcatgttacactcctgcaccatccctagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctaagctcctccctcagcaataactgtaagtactctttcatatcgtctccgaaatttttagccataggacccccaggaataagagaagggcaagccacattacagataaaccgaagtcccccccagtgagcattgccaaatgtaagattgaaataagcatgctggctagacccggtgatatcttccagataactggacagaaaatcgggcaagcaatttttaagaaaatcaacaaaagaaaaatcttccaggtgcacgtttagggcctcgggaacaacgatggagtacgtgcaaggggtgcgttccagcatggttagttagctgatctgtaaaaaacaaaaaataaaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcggccgaggaagcaataaggcactacaatgctcagtctcaagtccagcaaagcgatgccatgcggatgaagcacaaaattctcaggtgcgtacaaaatgtaattactcccctcctgcacaggcagcgaagcccccgatccctccagatacacatacaaagcctcagcgtccatagcttaccgagcagcagcacacaacaggcgcaagagtcagagaaagactgagctctaacctgtccacccgctctctgctcaatatatagcccagatctacactgacgtaaaggccaaagtctaaaaatacccgccaaataatcacacacgcccagcacacgcccagaaaccggtgacacactcagaaaaatacgcgcacttcctcaaacgcccaaactgccgtcatttccgggttcccacgctacgtcatcagaattcgactttcaaattccgtcgaccgttaaaaatgtcacccgccccgcccctaacggtcgccgctcccacagccaatcacagccccgcatccccaaattcaaacagctcatttgcatattaacgcgcaccaaaagtttgaggtatattattgatgatg

SEQ ID NO: 2 - protein, 504 aa, Unknown
  Synthetic Construct
MESRNPFQQGLPSGLLSSSFVENMEVPAPECNLRLLASTAGRHAEDPESPVTPGTPTPPAAAAGAAARGGGGPRREPESRSGPSGGGGGGVADLFPELRRVLTRSSSGRERGIKRERHEETSHRTELTVSLMSRRRPESVWWHEVQSQGIDEVSVMHEKYSLEQVKTCWLEPEDDWEVAIRNYAKLALKPDKKYKITKLINIRNSCYISGNGAEVEISTQERAAFRCCMMNMYPGVVGMEGVTFMNTRFRGDGYNGVVFMANTKLTVHGCSFFGFNNMCIEAWGSVSVRGCSFSANWMGVVGRTKSVVSVKKCLFERCHLGVMSEGEAKVKHCASTETGCFVLIKGNAKVKHNMICGASDERGYQMLTCAGGNSHMLATVHVASHPRKTWPEFEHNVMTRCNVHLGSRRGMFMPYQCNMQFVKVLLEPDAMSRVSLTGVFDMNVELWKILRYDESKTRCRACECGGKHARLQPVCVEVTEDLRPDHLVLSCNGTEFGSSGEESD

SEQ ID NO: 3 - protein, 142 aa, Unknown
  Synthetic Construct
MSGSASFEGGVFSPYLTGRLPSWAGVRQNVMGSTVDGRPVQPANSSTLTYATLSSSSVDAAAAAAAASAASAVRGMALGAGYYSSLVANSSSTNNPASLNEEKLLLLMAQLEALTQRLGELTQQVAQLQAETRAAVATVKTK

SEQ ID NO: 4 - protein, 394 aa, Unknown
  Synthetic Construct
MHPVLRQMRPHHPPPQQQPPPPQPALLPPPQQQQQLPATTAAAAVSGAGQTSQYDHLALEEGEGLARLGASSPERHPRVQMKRDAREAYVPKQNLFRDRSGEEPEEMRAARFHAGRELRRGLDRKRVLRDEDFEADELTGISPARAHVAAANLVTAYEQTVKEESNFQKSFNNHVRTLIAREEVTLGLMHLWDLLEAIVQNPTSKPLTAQLFLVVQHSRDNEAFREALLNITEPEGRWLLDLVNILQSIVVQERGLPLSEKLAAINFSVLSLGKYYARKIYKTPYVPIDKEVKIDGFYMRMTLKVLTLSDDLGVYRNDRMHRAVSASRRRELSDQELMHSLQRALTGAGTEGESYFDMGADLHWQPSRRALEAAAGPYVEEVDDEVDEGEYLED

SEQ ID NO: 5 - protein, 592 aa, Unknown
  Synthetic Construct
MQQQPPPPDPAMRAALQSQPSGINSSDDWTQAMQRIMALTTRNPEAFRQQPQANRLSAILEAVVPSRSNPTHEKVLAIVNALVENKAIRGDEAGLVYNALLERVARYNSTNVQTNLDRMVTDVREAVAQRERFHRESNLGSMVALNAFLSTQPANVPRGQEDYTNFISALRLMVTEVPQSEVYQSGPDYFFQTSRQGLQTVNLSQAFKNLQGLWGVQAPVGDRATVSSLLTPNSRLLLLLVAPFTDSGSINRNSYLGYLINLYREAIGQAHVDEQTYQEITHVSRALGQDDPGNLEATLNFLLTNRSQKIPPQYALSAEEERILRYVQQSVGLFLMQEGATPSAALDMTARNMEPSMYASNRPFINKLMDYLHRAAAMNSDYFTNAILNPHWLPPPGFYTGEYDMPDPNDGFLWDDVDSSVFSPRPGANERPLWKKEGSDRRPSSALSGREGAAAAVPEAASPFPSLPFSLNSIRSSELGRITRPRLLGEEEYLNDSLLRPEREKNFPNNGIESLVDKMSRWKTYAQEHRDDPSQGATSRGSAARKRRWHDRQRGLMWDDEDSADDSSVLDLGGSGGGNPFAHLRPRIGRMM

SEQ ID NO: 6 - protein, 541 aa, Unknown
  Synthetic Construct
MMRRAYPEGPPPSYESVMQQAMAAAMQPPLEAPYVPPRYLAPTEGRNSIRYSELAPLYDTTRLYLVDNKSADIASLNYQNDHSNFLTTVVQNNDFTPTEASTQTINFDERSRWGGQLKTIMHTNMPNVNEFMYSNKFKARVMVSRKTPNGVKVDENYDGSQDELKYEWVEFELPEGNFSVTMTIDLMNNAIIDNYLAVGRQNGVLESDIGVKFDTRNFRLGWDPVTELVMPGVYTNEAFHPDVVLLPGCGVDFTESRLSNLLGIRKRQPFQEGFQIMYEDLEGGNIPALLDVEAYEESKEKAEAEATAAVATAATTNADATTTRGDTFATVAEEAAALAVADDSESKIVIKPVKVDSKNRSYNVLPDEVNTAYRSWYLAYNYGDPEKGVRSWTLLTTSDVTCGVEQVYWSLPDMMQDPVTFRSTRQVSNYPVVGAELLPVYSKSFFNEQAVYSQQLRAFTSLTHVFNRFPENQILVRPPAPTITTVSENVPALTDHGTLPLRSSIRGVQRVTVTDARRRTCPYVYKALGIVAPRVLSSRTF

SEQ ID NO: 7 - protein, 195 aa, Unknown
  Synthetic Construct
MSILISPSNNTGWGLRAPSKMYGGARQRSTQHPVRVRGHFRAPWGALKGRVRSRTTVDDVIDQVVADARNYTPAAAPVSTVDAVIDSVVADARRYARAKSRRRRIARRHRSTPAMRAARALLRRARRTGRRAMLRAARRAASGSSSSAGRTRRRAATAAAAAIASMSRPRRGNVYWVRDAATGVRVPVRTRPPRT

SEQ ID NO: 8 - protein, 345 aa, Unknown
  Synthetic Construct
MSKRKYKEEMLQVIAPEIYGPAVKEERKPRKLKRVKKDKKEEEDVDGLVEFVREFAPRRRVQWRGRKVKPVLRPGTTVVFTPGERSGSASKRSYDEVYGDEDILEQAAERLGEFAYGKRSRPAPLKEEAVSIPLDHGNPTPSLKPVTLQQVLPSAAPRRGFKREGGEDLYPTMQLMVPKRQKLEDVLEHMKVDPEVQPEVKVRPIKQVAPGLGVQTVDIKIPTEPMETQTEPVKPSTSTMEVQTDPWMPAPAASTATRRRRKYGAASLLMPNYALHPSIIPTPGYRGTRFYRGYTSRRRKTTTRRRRRRSRRSSTATSALVRRVYRSGREPLTLPRARYHPSIAI

SEQ ID NO: 9 - protein, 77 aa, Unknown
  Synthetic Construct
MALTCRLRVPITGYRGRKPRRRRLTGNGLRRHHHRRRRAISKRLGGGFLPALIPIIAAAIGAIPGIASVAVQASQRH

SEQ ID NO: 10 - protein, 241 aa, Unknown
  Synthetic Construct
MEDINFSSLAPRHGTRPFMGTWSDIGNSQLNGGAFNWSSLWSGLKNFGSTLKTYGNKAWNSSTGQALREKLKEQNFQQKVVDGLASGINGVVDLANQAVQKQINSRLDAVPPAGSVEMPQVEEELPPLDKRGDKRPRPDAEETLLTHTDEPPPYEEAVKLGLPTTRPVAPLATGVLKPSSSSSQPATLDLPPPRPSTVAKPLPPVAVASRAPRGRPQANWQSTLNSIVGLGVQSVKRRRCY

SEQ ID NO: 11 - protein, 941 aa, Unknown
  Synthetic Construct
MATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNSLAPKGAPNTSQWKDSDSKMHTFGVAAMPGVVGKKIEADGLPIGIDSSSGTDTIIYADKTFQPEPQVGSDSWVDTNGAEEKYGGRALKDTTNMKPCYGSFARPTNKEGGQANIKDSETASTTPNYDIDLAFFDSKNIAANYDPDIVMYTENVELQTPDTHIVFKPGTSDESSEANLGQQAMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLNGVGFTDTYQGVKVKTDTAAAGTNGTQWDKDDTTVSTANEIHSGNPFAMEINIQANLWRNFLYANVALYLPDSYKYTPANITLPANTNTYDYMNGRVVAPSLVDAYINIGARWSLDPMDNVNPFNHHRNAGLRYRSMLLGNGRYVPFHIQVPQKFFAIKSLLLLPGSYTYEWNFRKDVNMILQSSLGNDLRTDGASIAFTSINLYATFFPMAHNTASTLEAMLRNDTNDQSFNDYLSAANMLYPIPANATNVPISIPSRNWAAFRGWSFTRLKTRETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVASVTQKKFLCDRVMWRIPFSSNFMSMGALTDLGQNMLYANSAHALDMNFEVDPMDESTLLYVVFEVFDVVRVHQPHRGVIEAVYLRTPFSAGNATT

SEQ ID NO: 12 - protein, 207 aa, Unknown
  Synthetic Construct
MTACGSGEQELRAILRDLGCGPYFLGTFDKRFPGFMAPHKLACAIVNTAGRETGGEHWLAFAWNPRSHTCYLFDPFGFSDERLKQIYQFEYEGLLRRSALATEDRCVTLEKSTQTVQGPRSAACGLFCCMFLHAFVHWPDRPMDKNPTMNLLTGVPNGMLQSPQVEPTLRRNQEALYRFLNAHSVYFRSHRARIEKATAFDRMNQDM

SEQ ID NO: 13 - protein, 801 aa, Unknown
  Synthetic Construct
METQPSSPTSPSAPAAAADENQQQNESLTAPPPSPTSDAAAPDMQEMEESIEIDLGYVTPAEHEEELAARFSAPEENHQEQPEQEAESEQQQAGLEHGDYLSGAEDVLIKHLARQCIIVKDALLDRAEVPLSVAELSRAYERNLFSPRVPPKRQPNGTCEPNPRLNFYPVFAVPEALATYHLFFKNQRIPVSCRANRTRADALLNLGPGARLPDIASLEEVPKIFEGLGSDETRAANALQGSGEEHEHHSALVELEGDNARLAVLKRTVELTHFAYPALNLPPKVMSAVMDQVLIKRASPLSEDEMQDPESSDEGKPVVSDEQLARWLGASSTPQSLEERRKLMMAVVLVTVELECLRRFFADAETLRKVEENLHYLFRHGFVRQACKISNVELTNLVSYMGILHENRLGQNVLHTTLRGEARRDYIRDCVYLYLCHTWQTGMGVWQQCLEEQNLKELCKLLQKNLKALWTGFDERTTAADLADLIFPERLRLTLRNGLPDFMSQSMLQNFRSFILERSGILPATCSALPSDFVPLTFRECPPPLWSHCYLLRLANYLAYHSDVIEDVSGEGLLECHCRCNLCTPHRSLACNPQLLSETQIIGTFELQGPGEGKGGLKLTPGLWTSAYLRKFVPEDYHPFEIRFYEDQSQPPKAELSACVITQGAILAQLQAIQKSRQEFLLKKGHGVYLDPQTGEELNPSFPQDAPRKQQEAESGAAAAAGGFGGRLGEQSGRGGGDGRLGQHSGRGGQPARQSGGRRGGGGGRGRSSRRQTVVLGGGGESKQHGYHLRSGSGSRRPGPQ

SEQ ID NO: 14 - protein, 227 aa, Unknown
  Synthetic Construct
MSKEIPTPYMWSYQPQMGLAAGAAQDYSTRMNWLSAGPAMISRVNDIRAHRNQILLEQSAITATPRHHLNPRNWPAALVYQEIPQPTTVLLPRDAQAEVQLTNSGVQLAGGAALCRHRPAQGIKRLVIRGRGTQLNDEVVSSSLGLRPDGVFQLAGSGRSSFTPRQAVLTLESSSSQPRSGGIGTLQFVEEFTPSVYFNPFSGSPGHYPDEFIPNFDAISESVDGYD

SEQ ID NO: 15 - protein, 106 aa, Unknown
  Synthetic Construct
MSHGGAADLARLRHLDHCRRFRCFARDLAEFAYFELPEEHPQGPAHGVRIVVEGGLDSHLLRIFSQRPILVEREQGHTRLTLYCICNHPGLHESLCCLLCTEYNKS

SEQ ID NO: 16 - protein, 178 aa, Unknown
  Synthetic Construct
MGKITLVSCGVLVAVVVLSIVGLGGAAVVKEEKADPCLHFNPDKCQLSFQPDGNRCTVLIKCGWECENVRIEYNNKTRNNTLASVWQPGDPEWYTVSVPGADGSPRTVNNTFIFAHMCDTVMWMSKQYDMWPPTKENIVVFSIAYSLCTALITAIVCLSINMFIAIRPRNNAEKEKQP

SEQ ID NO: 17 - protein, 206 aa, Unknown
  Synthetic Construct
MASVKFLLLFASLIAVIHGMSNEKITIYTGTNHTLKGPEKATEVSWYCYFNESDVSTELCGNNNKKNESITLIKFQCGSDLTLINITRDYVGMYYGTTAGILDMEFYQVSVSEPTTPRMTTTTKTTPVTTIQLTTNGFLAMLQVAENSTSIQPTPPSEEIPRSMIGIIVAVVVCMLIIALCMVYYAFCYRKHRLNDKLEHLLSVEF

SEQ ID NO: 18 - protein, 204 aa, Unknown
  Synthetic Construct
MKILGLLIFSIITSALCNSDNEDVTVVVGSNYTLKGPAKGMLSWYCYFGSDTTETELCNLKNGKIQNSKINNYICNGTDLILLNITKSYAGSYTCPGDDADSMIFYKVTVVDPTTPPPPTTTTHTTHTDQTAAEEAAKLALQVQDSSFVGITPTPDQRCPGLLVSGIVGVLSGLAVIIICMFIFACCYRRLYRQKSDPLLNLYV

SEQ ID NO: 19 - protein, 294 aa, Unknown
  Synthetic Construct
MKAVSALVFCSLIGIVFSAGFLKNLTIYEGENATLVGISGQNVSWLKYHLDGWKDICDWNVTVYTCNGVNLTITNATQDQNGRFKGQSFTRNNGYESHNMFIYDVTVIRNETATTQMPTTHSSTTTTMQTTQTTTTSTQHMTTTTAAKPSSAAPQPQALALKAAQASTTTRTNEQTTDFLSTVESHTTATSSAFSSTANLSSLSSTPISPATTPSPAHLPTPLKQTEDSGMQWQITLLIVIGLVILAVLLYYIFCRRIPNAHRKPVYKPIIVGQPEPLQVEGGLRNLLFSFTVW

SEQ ID NO: 20 - protein, 91 aa, Unknown
  Synthetic Construct
MIPRQFLITILICLLQVCATLALVANASPDCIGPFASYVLFAFITCICCCSIVCLLITFFQFIDWIFVRIAYLRHHPQYHDQRVARLLRLL

SEQ ID NO: 21 - protein, 135 aa, Unknown
  Synthetic Construct
MTDPLANNNVNDLLLDMDGRASEQRLAQLRIRQQQERAVKELQDGIAIHQCKKGIFCLVKQAKISYEVTPNDHRLSYELLQQRQKFTCLVGVNPIVITQQSGDTKGCIHCSCDSPDCVHTLIKTLCGLRDLLPMN

SEQ ID NO: 22 - protein, 425 aa, Unknown
  Synthetic Construct
MSKKRVRVDDDFDPVYPYDADNAPTVPFINPPFVSSDGFQEKPLGVLSLRLADPVTTKNGEITLKLGEGVDLDSSGKLISNTATKAAAPLSFSNNTISLNMDHPFYTKDGKLSLQVSPPLNILRTSILNTLALGFGSGLGLRGSALAVQLVSPLTFDTDGNIKLTLDRGLHVTTGDAIESNISWAKGLKFEDGAIATNIGNGLEFGSSSTETGVDDAYPIQVKLGSGLSFDSTGAIMAGNKEDDKLTLWTTPDPSPNCQILAENDAKLTLCLTKCGSQILATVSVLVVGSGNLNPITGTVSSAQVFLRFDANGVLLTEHSTLKKYWGYRQGDSIDGTPYTNAVGFMPNLKAYPKSQSSTTKNNIVGQVYMNGDVSKPMLLTITLNGTDDSNSTYSMSFSYTWTNGSYVGATFGANSYTFSYIAQE

SEQ ID NO: 23 - DNA, 600 bp, Unknown
  Simian adenovirus 36
  CDS (8)..(583): label=Elb\19K
aggactcatggagatctggactgtcttggaagactttcaccagactagacagctgctagagaactcatcggagggagtctcttacctgtggagattctgcttcggtgggcctctagctaagctagtctatagggccaaacaggattataaggatcaatttgaggatattttgagagagtgtcctggtatttttgactctctcaacttgggccatcagtctcactttaaccagagtattctgagagcccttgacttttctactcctggcagaactaccgccgcggtagccttttttgcctttatccttgacaaatggagtcaagaaacccatttcagcagggattaccgtctggactgcttagcagtagctttgtggagaacatggaggtgccagcgcctgaatgcaatctccggctacttgccagtacagccggtagacacgctgaggatcctgagtctccagtcaccccaggaacaccaacgccgccagcagccgcagcaggagcagcagcaagaggaggaggaggaccgagaagagaacccgagagccggtctggaccctccggtggcggaggaggaggagtagctgacttgtttccc

SEQ ID NO: 24 - protein, 192 aa, Unknown
  Synthetic Construct
MEIWTVLEDFHQTRQLLENSSEGVSYLWRFCFGGPLAKLVYRAKQDYKDQFEDILRECPGIFDSLNLGHQSHFNQSILRALDFSTPGRTTAAVAFFAFILDKWSQETHFSRDYRLDCLAVALWRTWRCQRLNAISGYLPVQPVDTLRILSLQSPQEHQRRQQPQQEQQQEEEEDREENPRAGLDPPVAEEEE

SEQ ID NO: 25 - DNA, 5920 bp, Unknown
  Simian adenovirus 36
  CDS (2)..(571): label=22K
  CDS (1875)..(2498): label=E3\CR1-alpha
  CDS (5485)..(5916): label=E3\RID\beta
gatgccccgaggaagcagcaagaagctgaaagtggagctgccgctgccgccggaggatttggaggaagactgggagagcagtcaggcagaggaggaggagatggaagactgggacagcactcaggcagaggaggacagcctgcaagacagtctggaggaagacgaggtggaggaggaggcagaggaagaagcagccgccgccagaccgtcgtcctcggcggaggaggagaaagcaagcagcacggataccatctccgctccgggtcggggtcgcggcggccgggcccacagtaggtgggacgagaccgggcgcttcccgaaccccaccacccagaccggtaagaaggagcggcagggatacaagtcctggcgggggcacaaaaacgccatcgtctcctgcttgcaagcctgcgggggcaacatctccttcacccggcgctacctgctcttccaccgcggggtgaacttcccccgcaacatcttgcattactaccgtcacctccacagcccctactactgtttccaagaagaggcagaaacccagcagcagcagcagaaaaccagcggcagctagaaaatccacagcggcggcggcaggtggactgaggatcgcggcgaacgagccggcgcagacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccacacacggaaaaaggcgggaattacgtcaccacctgcgcccttcgcccgaccatcatcatgagcaaagagattcccacgccttacatgtggagctaccagccccagatgggcctggccgccggcgccgcccaggactactccacccgcatgaactggctcagtgccgggcccgcgatgatctcacgggtgaatgacatccgcgcccaccgaaaccagatactcctagaacagtcagcgatcaccgccacgccccgccatcaccttaatccgcgtaattggcccgccgccctggtgtaccaggaaattccccagcccacgaccgtactacttccgcgagacgcccaggccgaagtccagctgactaactcaggtgtccagctggccggcggcgccgccctgtgtcgtcaccgccccgctcagggtataaagcggctggtgatccgaggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggtggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcagctgacctagctcggcttcgacacctggaccactgccgccgcttccgctgcttcgctcgggatctcgccgagtttgcctactttgagctgcccgaggagcaccctcagggcccggcccacggagtgcggatcgtcgtcgaagggggcctcgactcccacctgcttcggatcttcagccagcgtccgatcctggtcgagcgcgagcaaggacatacccgtctgaccctgtactgcatctgcaaccaccccggcctgcatgaaagtctttgttgtctgctgtgtactgagtataataaaagctgagatcagcgactactccggacttccgtgtgttcctgaatccatcaaccagtctttgttcttcaccgggaacgagaccgagctccagctccagtgtaagccccacaagaagtacctcacctggctgttccagggctccccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcgccgctccccgctactaacaaccaaactacccaccaacgccgccgtcgcgacctttctgaatctaatactaccacccacaccggaggtgagctccgaggtcgaccaacctctgggatttactacggcccctgggaggtggtagggttaatagcgctaggcctagttgcgggtgggcttttggctctctgctacctatacctcccttgctgttcgtacttagtggtgctgtgttgctggtttaagaaatggggaagatcaccctagtgagctgcggtgtgctggtggcggtggtggtgctttcgattgtgggactgggcggcgcggctgtagtgaaggaggagaaggccgatccctgcttgcatttcaatcccgacaaatgccagctgagttttcagcccgatggcaatcggtgcacggtgctgattaagtgcggatgggaatgcgagaacgtgagaatcgagtacaataacaagactcggaacaatactctcgcgtccgtgtggcagcccggggaccccgagtggtacaccgtctctgtccccggtgctgacggctccccgcgcaccgtgaataatactttcatttttgcacacatgtgcgacacggtcatgtggatgagcaagcagtacgatatgtggccccccacgaaggagaacatcgtggtcttctccatcgcttacagcctgtgcacggcgctaatcaccgctatcgtgtgcctgagcattaacatgttcatcgctattcgccccagaaataatgccgaaaaagagaaacagccataacacgtttttttcacacacctttttcagaccatggcctctgttaaatttttgcttttatttgccagtctcattgccgtcattcatggaatgagtaatgagaaaattactatttacactggcactaatcacacattgaaaggtccagaaaaagccacagaagtttcatggtattgttattttaatgaatcagatgtatctactgaactctgtggaaacaataacaaaaaaaatgagagcattactctcatcaagtttcaatgtggatctgacttaaccctaattaacatcactagagactatgtaggtatgtattatggaactacagcaggcattttggacatggaattttatcaagtttctgtgtctgaacccaccacgcctagaatgaccacaaccacaaaaactacacctgttaccactatacagctcactaccaatggctttcttgccatgcttcaagtggctgaaaatagcaccagcattcaacccaccccacccagtgaggaaattcccagatccatgattggcattattgttgctgtagtggtgtgcatgttgatcatcgccttgtgcatggtgtactatgccttctgctacagaaagcacagactgaacgacaagctggaacacttactaagtgttgaattttaattttttagaaccatgaagatcctaggccttttaattttttctatcattacctctgctctatgcaattctgacaatgaggacgttactgtcgttgtcggatcaaattatacactgaaaggtccagcgaagggtatgctttcgtggtattgctattttggatctgacactacagaaactgaattatgcaatcttaagaatggcaaaattcaaaattctaaaattaacaattatatatgcaatggtactgatctgatactcctcaatatcacgaaatcatatgctggcagttacacctgccctggagatgatgctgacagtatgattttttacaaagtaactgttgttgatcccactactccacctccacccaccacaactactcacaccacacacacagatcaaaccgcagcagaggaggcagcaaagttagccttgcaggtccaagacagttcatttgttggcattacccctacacctgatcagcggtgtccggggttgctcgtcagcggtattgtcggtgtgctttcgggattagcagtcataatcatctgcatgttcatttttgcttgctgctatagaaggctttaccgacaaaaatcagacccactgctgaacctctatgtttaattttttccagagccatgaaggcagttagcgctctagttttttgttctttgattggcattgtttttagtgctgggtttttgaaaaatcttaccatttatgaaggtgagaatgccactctagtgggcatcagtggtcaaaatgtcagctggctaaaataccatctagatgggtggaaagacatttgcgattggaatgtcactgtgtatacatgtaatggagttaacctcaccattactaatgccacccaagatcagaatggtaggtttaagggccagagtttcactagaaataatgggtatgaatcccataacatgtttatctatgacgtcactgtcatcagaaatgagactgccaccacacagatgcccactacacacagttctaccactactaccatgcaaaccacacagacaaccactacatcaactcagcatatgaccaccactacagcagcaaagccaagtagcgcagcgcctcagccacaggctttggctttgaaagctgcgcaagctagtacaactactaggaccaatgagcagactactgattttttgtccactgtcgagagccacaccacagctacctcgagtgccttctctagcaccgccaatctctcctcgctttcctctacaccaatcagtcccgctactactcctagccccgctcatcttcccactcccctgaagcaaactgaggacagcggcatgcaatggcagatcaccctgctcattgtgatcgggttggtcatcctggccgtgttgctctactacatcttctgccgccgcattcccaacgcgcaccgcaagccggtctacaagcccatcattgtcgggcagccggagccgcttcaggtggaagggggtctaaggaatcttctcttctcttttacagtatggtgattgaactatgattcctagacaattcttgatcactattcttatctgcctcctccaagtctgtgccaccctcgctctggtggccaacgccagtccagactgtattgggcccttcgcctcctacgtgctctttgccttcatcacctgcatctgctgctgtagcatagtctgcctgcttatcaccttcttccagttcattgactggatctttgtgcgcatcgcctacctgcgccaccacccccagtaccacgaccagcgagtggcgcggctgctcaggctcctctgataagcatgcgggctctgctacttctcgcgcttctgctgttagtgctcccccgtcccgtcgacccccggtcccccactcagtcccccgaggaggttcgcaaatgcaaattccaagaaccctggaaattcctcaaatgctaccgccaaaaatcagacatgcatcccagctggatcatgatcattgggatcgtgaacattctggcctgcaccctcatctcctttgtgatttacccctgctttgactttggttggaactcgccagaggcgctctatctcccgcctgaacctgacacaccaccacagcagcaacctcaggcacacgcactaccaccaccacagcctaggccacaatacatgcccatattagactatgaggccgagccacagcgacccatgctccccgctattagttacttcaatctaaccggcggagatgactgac

SEQ ID NO: 26 - protein, 190 aa, Unknown
  Synthetic Construct
MPRGSSKKLKVELPLPPEDLEEDWESSQAEEEEMEDWDSTQAEEDSLQDSLEEDEVEEEAEEEAAAARPSSSAEEEKASSTDTISAPGRGRGGRAHSRWDETGRFPNPTTQTGKKERQGYKSWRGHKNAIVSCLQACGGNISFTRRYLLFHRGVNFPRNILHYYRHLHSPYYCFQEEAETQQQQQKTSGS

SEQ ID NO: 27 - protein, 208 aa, Unknown
  Synthetic Construct
MKVFVVCCVLSIIKAEISDYSGLPCVPESINQSLFFTGNETELQLQCKPHKKYLTWLFQGSPIAVVNHCDNDGVLLSGPANLTFSTRRSKLQLFQPFLPGTYQCVSGPCHHTFHLIPNTTAPLPATNNQTTHQRRRRDLSESNTTTHTGGELRGRPTSGIYYGPWEVVGLIALGLVAGGLLALCYLYLPCCSYLVVLCCWFKKWGRSP

SEQ ID NO: 28 - protein, 144 aa, Unknown
  Synthetic Construct
MRALLLLALLLLVLPRPVDPRSPTQSPEEVRKCKFQEPWKFLKCYRQKSDMHPSWIMIIGIVNILACTLISFVIYPCFDFGWNSPEALYLPPEPDTPPQQQPQAHALPPPQPRPQYMPILDYEAEPQRPMLPAISYFNLTGGDD

SEQ ID NO: 29 - DNA, 850 bp, Unknown
  Simian adenovirus 36
  CDS (2)..(338): label=33K
  CDS (508)..(842): label=33K
gatgccccgaggaagcagcaagaagctgaaagtggagctgccgctgccgccggaggatttggaggaagactgggagagcagtcaggcagaggaggaggagatggaagactgggacagcactcaggcagaggaggacagcctgcaagacagtctggaggaagacgaggtggaggaggaggcagaggaagaagcagccgccgccagaccgtcgtcctcggcggaggaggagaaagcaagcagcacggataccatctccgctccgggtcggggtcgcggcggccgggcccacagtaggtgggacgagaccgggcgcttcccgaaccccaccacccagaccggtaagaaggagcggcagggatacaagtcctggcgggggcacaaaaacgccatcgtctcctgcttgcaagcctgcgggggcaacatctccttcacccggcgctacctgctcttccaccgcggggtgaacttcccccgcaacatcttgcattactaccgtcacctccacagcccctactactgtttccaagaagaggcagaaacccagcagcagcagcagaaaaccagcggcagctagaaaatccacagcggcggcggcaggtggactgaggatcgcggcgaacgagccggcgcagacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgc

SEQ ID NO: 30 - protein, 224 aa, Unknown
  Synthetic Construct
MPRGSSKKLKVELPLPPEDLEEDWESSQAEEEEMEDWDSTQAEEDSLQDSLEEDEVEEEAEEEAAAARPSSSAEEEKASSTDTISAPGRGRGGRAHSRWDETGRFPNPTTQTAPTTVSKKRQKPSSSSRKPAAARKSTAAAAGGLRIAANEPAQTRELRNRIFPTLYAIFQQSRGQEQELKVKNRSLRSLTRSCLYHKSEDQLQRTLEDAEALFNKYCALTLKE

SEQ ID NO: 31 - DNA, 870 bp, Unknown
  Simian adenovirus 36
  CDS (6)..(573): label=Ela
  CDS (658)..(863): label=Ela
gaaagatgaggcacctgagagacctgcccggtaatgttttcctggctactgggaacgagattctggaactggtggtggacgccatgatgggtgacgaccctcctgagccccataccccatttgaggcgccttcgctgtacgatttgtatgatctggaggtggatgtgcccgagaacgaccccaacgaggaggcggtgaatgatttgtttagcgatgccgcgctgctggctgccgagcaggctaatacggactctggctcagacagcgattcctctctccataccccgagacccggcagaggtgagaaaaagatccccgagcttaaaggggaagagcttgacctgcgctgctatgaggaatgcttgcctccgagcgatgatgaggaggacgaggaggcgattcgagctgcagcgaaccagggagtgaaagcagcgagcgagggctttagcctggactgtcctactctgcccggacacggctgtaagtcttgtgaatttcatcgcatgaatactggagataagaatgtgatgtgtgccctgtgctatatgagagcttacaaccattgtgtttacagtaagtgtgattaactttagttgggaaggcagagggtgactgggtgctgactggtttatttatgtatatgttttttatgtgtaggtcccgtctctgacgcagatgagacccccacttcagagtgcatttcatcacccccagaaattggcgaggaaccgcccgaagatattattcatagaccagttgcagtgagagtcaccgggcggagagcagctgtggagagtttggatgacttgctacagggtggggatgaacctttggacttgtgtacccggaaacgccccaggcactaagtgc

SEQ ID NO: 32 - protein, 258 aa, Unknown
  Synthetic Construct
MRHLRDLPGNVFLATGNEILELVVDAMMGDDPPEPHTPFEAPSLYDLYDLEVDVPENDPNEEAVNDLFSDAALLAAEQANTDSGSDSDSSLHTPRPGRGEKKIPELKGEELDLRCYEECLPPSDDEEDEEAIRAAANQGVKAASEGFSLDCPTLPGHGCKSCEFHRMNTGDKNVMCALCYMRAYNHCVYSPVSDADETPTSECISSPPEIGEEPPEDIIHRPVAVRVTGRRAAVESLDDLLQGGDEPLDLCTRKRPRH

SEQ ID NO: 33 - DNA, 37786 bp, Unknown
  Simian adenovirus 42.1
  repeat_region (1)..(109): ITR
  CDS (1989)..(3512): E1b\55K
  CDS (3612)..(4052): pIX
  misc_feature (4117)..(5741): IVa2   complement (4117..5450,5729..5741)
  misc_feature (5223)..(14216): pol   complement (5223..8825,14208..14216)
  misc_feature (8627)..(14216): pTP   complement (8627..10618,14208..14216)
  CDS (11097)..(12356): 52K
  CDS (12383)..(14152): pIIIa
  CDS (14258)..(16000): penton
  CDS (16006)..(16602): pVII
  CDS (16696)..(17817): V
  CDS (17845)..(18084): pX
  CDS (18191)..(18967): pVI
  CDS (19098)..(21968): hexon
  CDS (22001)..(22633): protease
  misc_feature (22764)..(24404): DBP   complement
  CDS (24442)..(26934): 100K
  CDS (27648)..(28328): pVIII
  CDS (28603)..(29157): E3\CR1-alpha
  CDS (29344)..(29820): E3\gp19K
  CDS (29852)..(30751): E3\CR1\beta
  CDS (31575)..(31844): E3\RID-alpha
  CDS (31850)..(32248): E3\RID-beta
  CDS (32836)..(34566): fiber
  misc_feature (34755)..(35912): E4\orf6/7  complement (34755..35027,35730..35912)
  misc_feature (35031)..(35912): E4\orf6  complement
  misc_feature (35815)..(36180): E4\orf4  complement
  misc_feature (36190)..(36534): E4\orf3  complement
  misc_feature (36534)..(36923): E4\orf2  complement
  misc_feature (36987)..(37370): E4\orf1  complement
  repeat_region (37678)..(37786): ITR   complement
catcatcaataatataccttattttggattgaagccaatatgataatgaggtgggcggagcggggcggggcggggaggagcggcggcgcggggcgggccgggaggtgtggcggaagttgagtttgtaagtgtggcggatgtgacttgctagcgccggatgtggtaaaagtgacgtttttggagtgcgacaacgcccacgggaagtgacatttttcccgcggtttttaccggatgtcgtagtgaatttgggcgttaccaagtaagatttggccattttcgcgggaaaactgaaatggggaagtgaaatctgattaatttcgcgttagtcataccgcgtaatatttgccgagggccgagggactttgaccgattacgtggaggaatcgcccaggtgttttttgaggtgaatttccgcgttccgggtcaaagtctccgttttattattatagtcagctgacgcggagtgtatttatacccgctgatctcgtcaagaggccactcttgagtgccagcgagtagagttttctcctctgccgctccgctccgctctgacaccgggggaaaaatgagacatttcacctacgatggcggtgtgctcaccggccagctggctgcctcggtcctggacgccctgatcgaggaggtattggccgacaattatcctcctccagctcattttgagccacctactcttcacgaactgtatgatttggacgtggtggcacctagcgacccgaacgagcaggcggtttccagtttttttcctgactctatgctgttggccagccaggagggggtcgagctcgagacccctcctccaatcgccgtttctcctgagcctccgaccctgaccaggcagcccgatcgccgtgttggacctgcgactatgccccatctgctgcccgaggtgatcgatctcacctgtaacgagtctggttttccacccagcgaggatgaggacgaagagggtgagcagtttgtgttagattctgtggaggaacccgggcgcggttgcagatcttgtcaataccatcggaaaaatacaggagacccccaaattatgtgttccctgtgttatatgaagacgacctgtatgtttatttacagtaagtttgtgattggtgggtcggtgggctgtagtgtgggtaggtggtctgtggttttttttttttaatatcagcttgggctaaaaaaactgctatggtaattttttaaggtccggtgtctgaacctgagcaggaagctgaaccggagcctgagagtcgccccaggagaaggcctgcaattctaactagaccgagtgcacctgtagcgagggacctcagcagtgcagagaccaccgattccggtccttcctcatcccctccagagattcatcccgtggtgcctttgtgtcccctcaagcccgttgccgtgagagttagtgggcggagggccgccgtggagagcattgaggacttgcttaatgagacacaggaacctttggacttgagctgtaaacgccctaggcaataaacctgcttacctggactgaatgagttgacgcctatgtttgcttttgaatgacttaatgtgtatataataaagagtgagataatgtttaattgcatggtgtgtttgattggggcggggtttgttgggtatataagcttccctgggctaaacttggttacacttgacctcatggaggcctgggagtgtttagagagctttgccgaagtgcgtgccttgctggaagagagctctaataatacctctgggtggtggaggtatttttggggctctccccaggctaagttagtttgtagaatcaaggaggattacaagtgggaatttgaacagcttttgaaatcctgtggtgagctcttggattctttgaatctgggccaccaggctcttttccaggacaagatcatcaggactttggatttttccacaccggggcgcattgctgctggggttgcttttctagcttttttgaaggataaatggagcgaagagacccacttgagttcgggatacgtcctggattttctggccatacaactgtggagagcatggatcaggcacaagaacagaatgcaactgttgtcttccgtccgtccgttgctgattcagccggaggagcagcagaccgggccggaggaccgggctcgtctggaaccagaagagagggcgcccgcagcggcgccggagaggagcgcgtggaacctgggagccggcctgaacggccatccacatcgggagtgaatgttggacaggtggcggatctctttccagaactgcgacgaatcttgactatcagggaggatggacaatttgttaaggggcttaagagggagcggggggcttctgaacataacgaggaggccagtaatttagcttttagtctgatgaccagacaccgtcccgagtgcattacttttcagcagattaaggataattgtgccaatgagttagatctgctgggtcagaagtacagcatagagcagttgaccacttactggctgcagccgggtgatgatctggaggaagctattagggtgtatgccaaggtggccctgaggcccgattgcaagtacaagctcaaggggctggtgaatatcaggaattgttgctacatttctgggaacggggcggaggtggagatagagaccgatgacagggtggcctttaggtgcagcatgatgaatatgtggcctggggtactgggcatggacggggtggtgattatgaatgtgaggtttacggggcccaattttaatggtacggtgttcctgggcaacaccaacctggtgctgcacggggtgagcttctatggctttaacaacacctgtgtggaggcctggaccgatgtgaaggtccgtggctgtgccttctacggatgttggaaggcggtagtgtgtcgccccaagagcaggagttccattaaaaaatgcttgtttgagaggtgcaccctgggggtgctggcggagggcaactgtcgggtgcgccacaatgtggcctccgaatgcggttgcttcatgctagtcaagagcgtggcggtcatcaagcataacatggtgtgtggcaacagcgaggacaaggcctcgcagatgctgacctgctcggatggcaactgccacttactgaagaccatccatataaccagccacagccgcaaggcctggcccgtgttcgagcacaatgtgttgacccgctgctccttgcatctgggcaacaggagaggtgtgttcctgccctatcaatgcaacttgagccacaccaaggtcttgctagagcccgaaagcatgtccaaggtgaacctgaacggggtgtttgacatgaccctgaagatatggaaggtgctgaggtacgacgaaaccaggtcccggtgcaggccctgcgagtgcgggggcaagcatatgaggaaccagcctgtgatgctggatgtgaccgaggagctgaggcctgaccacttggttctggcctgcaccagggccgagtttggttctagcgatgaagacacagactgaggtgggtgagtgggcgtggtctgggggtgggaagcaatatataagttgggggtcttagggtctctgtgtctgttttgcagagggaccgccggcgccatgagcgggagcagtagcagcaacgccttggatggcagcatcgtgagcccttatttgacgacgcgcatgccccactgggccggggtgcgtcagaatgtgatgggctccagcatcgacggacgacccgtgctgcccgcaaattccgccacgctgacctacgcgaccgtcgcggggaccccgttggacgccaccgccgccgccgccgccaccgccgccgcctcggccgtgcgcagcctggccacggactttgcattcttgggacccttggccaccggggcggccgcccgtgccgccgttcgcgatgacaagctgaccgccctgctggcgcagttggatgcgcttacccgggaactgggtgacctttcgcagcaggtcgtggccctgcgccagcaggtctccgccctgcaggctagcgggaatgcttctcctgcaaatgccgtttaagataaataaaaccagactctgtttggattaaagaaaagtagcaagtgcattgctctctttatttcataattttccgcgcgcgataggcccgagtccagcgttctcggtcgttgagggtgcggtgtatcttctccaggacgtggtagaggtggctctggacgttgagatacatgggcatgagcccgtcccgggggtggaggtagcaccactgcagagcttcatgctccggggtggtgttgtagatgatccagtcgtagcaggagcgctgggcatggtgcctaaaaatgtccttaagcagcaggccgatggccagggggaggcccttggtgtaagtgtttacaaaacggttgagttgggaagggtgcatgcggggtgagatgatgtgcatcttagattgtatttttagattggcgatgtttcctcccagatcccttctgggattcatgttgtggaggaccaccagcacagtatatccggtgcacttgggaaatttgtcatgcagcttagagggaaatgcgtggaagaacttggagacgcccttgtggcctcccagattctccatgcattcgtccatgatgatggcaatgggcccgcgggaggcggcctgggcaaagatgtttctggggtcactgacatcgtagttgtgttccagggtgagatcgtcataggccatttttataaagcgcgggcggagggtgcccgactgggggatgatggttccctcgggccccggggcgtagttgccttcgcagatctgcatttcccaggccttaatctctgaggggggaatcatatccacttgcggggcgatgaagaaaacggtttccggagccggggagattaactgggatgagagcaggtttctcagcagctgtgactttccacagccggtgggcccataaataacacctataaccggctgcagctggtagttgagcgagctgcagctgccgtcgtcccggaggaggggggccacctcattgagcatgtcccggacgcgcttgttctcctcgaccaggtccgccagaaggcgctcgccgcccagggacagcagctcttgcaaggaagcaaagtttttcagcggtttgaggccgtccgccgtgggcatgtttttcagggtctggccgagcagctccaggcggtcccagagctcggtgacgtgctctacggcatctctatccagcatatctcctcgtttcgcgggttggggcggctttcgctgtagggcaccaggcgatggtcgtccagcgcggccagagtcatgtccttccatgggcgcagggtcctcgtcagggtggtctgggtcacggtgaaggggtgcgccccgggctgggcgctggccagggtgcgcttgagactggtcctgctggtgctgaagcgctgccggtcttcgccctgcgcgtcggccaggtagcatttgaccatggtgtcgtagtccagcccctccgcggcgtgtcccttggcgcgcagcttgcccttggaggtggcgccgcacgcggggcactgcaggctcttgagcgcgtagagcttgggggcgaggaagaccgattcgggggagtaggcgtccgcgccgcaggccccgcacacggtctcgcactccaccagccaggtgagctcggggcgctcggggtcaaaaaccaggtttcccccatgctttttgatgcgtttcttacctcgggtctccatgaggcggtgtccccgttcggtgacgaagaggctgtccgtgtctccgtagaccgacttgaggggtctgtcctccaggggggtccctcggtcctcttcgtagagaaactcggaccactctgagacaaaggcccgcgtccaggccaggacgaaggaggccaggtgggaggggtaccggtcgttgtccactagggggtccaccttctccaaggtgtgaagacacatgtcgccctcctcggcgtccaggaaggtgattggcttgtaggtgtaggccacgtgacccggggttccggaagggggggtataaaagggggtgggggcgcgctcgtcctcactctcttccgcatcgctgtctgcgagggccagctgctggggtgagtattccctctcgaaggcgggcatgacctcagcgctgaggctgtcagtttctaaaaacgaggaggatttgatgttcacctgtcccgagctgatgcctttgagggtgcccgcgtccatctggtcagaaaacacgatctttttattgtccagcttggtggcgaacgacccgtagagggcgttggagagcagcttggcgatggagcgcagggtctgattcttgtcccggtcggcgcgctccttggccgcgatgttgagctgcacgtactcgcgcgcgacgcagcgccactcggggaagacggtggtgcgctcgtcgggcaccaggcgcacgcgccagccgcggttgtgcagggtgacgaggtccacgctggtggcgacctcgccgcgcaggcgctcgttggtccagcagaggcgcccgcccttgcgcgagcagaaggggggcagggggtcgagttgggtttcgtccggggggtccgcgtccaccgtgaagaccccggggcgcaggcgcgcgtcgaagtagtcgatcttgcatccttgcaagtccagcgcccgctgccagtcgcgggcggcgagcgcgcgctcgtaggggttgagcggcgggccccagggcatggggtgggtgagcgcggaggcgtacatgccgcagatgtcatagacgtagaggggctcccggaggatgcccaggtaggtggggtagcagcggccgccgcggatgctggcgcgcacgtagtcgtagagctcgtgcgagggggcgaggaggtcggggcccaggttggtgcgggcggggcgctccgcgcggaagacgatctgcctgaagatggcatgcgagttggaagagatggtggggcgctggaagacgttgaagctggcgtcctgtaggccgacggcgtcgcgcacgaaggaggcgtaggactcgcgcagcttgtgcaccagctcggcggtgacctgcacgtcgagcgcgcagtagtcgagggtctcgcggatgatgtcatacttagcctgccccttctttttccacagctcgcggttgaggacgaactcttcgcggtctttccagtactcttggattgggaaaccgtccggctccgaacggtaagagcccagcatgtagaactggttgacggcctggtaggcgcagcagcccttctccacgggcagggcgtaggcctgcgcggccttgcggagcgaggtgtgggtcagggcgaaggtgtccctgaccatgaccttgaggtactggtgtttgaagtcggagtcgtcgcagccgccccgctcccagagcgtgaagtcggtgcgctttttggagcgggggttgggcagcgcgaaggtgacatcgttgtagaggatcttgcccgcgcgaggcatgaagttgcgggtgatgcggaagggccccggcacttccgagcggttgttgatgacctgggcggcgagcacgatctcgtcgaagccgttgatgttgtggcccacgatgtagagttccaggaagcggggccggcccttgacgctgggcagcttttttagcttttcgtaggtgagctcctcgggcgaggcgaggccgtgctcggccagggcccagtccgccaggtgcgggttgtccgcgaggaaggaccgccagaggtcgcgggccaggagggtctgcaggcggtccctgaaggtcctgaactggcggcctacggccatcttttcgggggtgacgcagtagaaggtgagggggtcttgctgccaggagtcccagtcgagctccagggcgagatcgcgcgcggcggcgaccaggcgctcgtcgcccccgaatttcatgaccagcatgaagggcacgagctgctttccgaaggcgcccatccaagtgtaggtctctacatcgtaggtgacaaagagacgttccgtgcgaggatgcgagccgatcgggaagaactggatctcccgccaccagttggaggagtggctgttgatgtggtgaaagtagaagtcccgtcggcgggccgagcactcgtgctggcttttgtaaaagcgagcgcagtactggcagcgctgcacgggctgtacctcttgcacgagatgcacctgccgaccgcggacgaggaagctgagtgggaatctgagccccccgcatggctcgcggcctggctggtgctcttctactttggatgcgtggccgtcaccgtctggctcctcgaggggtgttacggtggagcggaccaccacgccgcgcgagccgcaggtccagatatcggcgcgcggcggtcggagtttgatgacgacatcgcgcagctgggagctgtccatggtctggagctcccgcggcggcggcaggtcagccgggagttcttgcaggtttacctcgcagagacgggccagggcgcggggcaggtccaggtggtacttgaactcgagaggggtgttggtggcggcgtcgatggcttgcaggaggccgcagccccggggcgcgacgacggtgccccgcggggcggtgaagctgccgccgccgctcctgctgtcgccgccggtggcggggcttagaagcggtgccgcggtcgggcccccggaggtagggggggctccggtcccgcgggcaggggcggcagcggcacgtcggcgccgcgcgcgggcaggagctggtgctgcgcccggaggttgctggcgaaggcgacgacgcggcggttgatctcctggatctggcgcctctgcgtgaagacgacgggtccggtgagcttgaacctgaaagagagttcgacagaatcaatctcggtgtcattgaccgcgacctggcgcaggatctcctgcacgtcgcccgagttgtcttggtaggcgatctcggccatgaactgttcgatctcttcctcctggaggtctccgcgtccggcgcgctccacggtggccgccaggtcgttggagatgcgcgccatgagctgcgagaaggcgttgagtccgccctcgttccagactcggctgtagaccacgccgccctggtcgtcgcgggcgcgcatgaccacctgcgcgaggttgagttccacgtggcgcgcaaagacggcgtagttgcgcaggcgctggaagaggtagttgagggtggtggcggtgtgctcggccacgaagaagtacatgacccagcggcgcaacgtggattcgttgatgtcccccaaggcctccagtcgctccatggcctcgtagaagtccacggcgaagttgaaaaactgggagttgcgcgccgacacggtcaactcctcctccagaagacggatgagctcggcgacggtgtcgcgcacctcgcgctcgaaggctatgggaatctcttcctccgccagcatcaccacctcttcctcttcttcctcctctggcacttccatgatggcttcctcctcttcggggggtggcggcgggggagggggcgctcggcgccggcggcggcgcaccgggaggcggtccacgaagcgctcgatcatctccccgcggcggcgacgcatggtctcggtgacggcgcggccgttctctcgggggcgcagctggaagacgccgccggtcatctggtgctggggcgggtggccgtggggcagcgagaccgcgctgacgatgcatcttaacaattgctgcgtaggtacgccgccgagggacctgagggagtccagatccaccggatccgaaaacctttcgaggaaggcatctaaccagtcgcagtcgcaaggtaggctgagcaccgtggcgggtggcggggggtggggggagtgtctggcggaggtgctgctgatgatgtaattgaagtaggcggtcttgacacggcggatggtcgacaggagcaccatatccttgggcccggcctgctggatgcggaggcggtcggccatgccccaggcttcgttctggcatctgcgcaggtctttgtagtagtcttgcatgagcctttccaccggcacctcttctccttcttcttctgacatctctgctgcatctgcagccctggggcggcggcgcgcgcccctgccccccatgcgcgtcaccccgaaccccctgagcggctggagcagggccaggtcggcgacgacgcgctcggccaggatggcctgctggacctgcgtgagggtggtttggaagtcatccaagtccacgaagcggtggtaggcgcccgtgttgatggtgtaggtgcagttggccatgacggaccagttgacggtctggtggcccggttgcgtcatctcggtgtacctgaggcgcgagtaggcgcgcgagtcgaagatgtagtcgttgcaagtccgcaccaggtactggtagcccaccaggaagtgcggcggcggctggcggtagaggggccagcggagggtggcgggggctccgggggccaggtcttccagcatgaggcggtggtattcgtagatatacctggacatccaggtgatgcccgcggcggtggtggaggcgcgcgggaagtcgcgcacccggttccagatgttgcgcagcggcagaaagtgctccatggtaggcgtgctctggccggtcaggcgcgcgcagtcgttgatactctagaccagggaaaacgaaagccggtcagcgggcactcttccgtggtctggtggataaattcgcaagggtatcatggcggagggcctcggttcgagccccgggcccgggccggacggtccgccatgatccacgcggttaccgcccgcgtgtcgaacccaggtggcgacgtcagacaacggtggagtgttccttttgggtttttttccaaattttttttggccgggcgccgacgcccgccgcgtaagagactagagtgcaaaagcgaaagcagtaagtggctcgctccctgtagcccggaggatccttgctaagggttgcgttgcggcgaaccccggttcgagtctggctctcgctgggccgctcgggtcggccggaaccgcggctaaggcgggattggcctccccctcattaaagaccccgcttgcggattcctccggacacaggggacgagcccctttttacttttgcttttctcagatgcatccggtgctgcggcagatgcgccccccgccccagcagcagcagcagcaacatcagcaagagcggcaccagcagcagcgggagtcatgcagggccccctcgcccacgctcggcggtccggcgacctcggcgtccgcggccgtgtctggagccggcggcggggggctggcggacgacccggaggagcccccgcggcgcagggccagacagtacttggacctggaggagggcgagggcctggcgcgactgggggcgccgtcccccgagcgccacccgcgggtgcagctgaagcgcgactcgcgcgaggcgtacgtgcctcggcagaacctgttcagagaccgcgcgggcgaggagcccgaggagatgcgggaccgcaggttcgccgcggggcgggagctgcggcaggggctgaaccgggagcggctgctgcgcgaggaggactttgagcccgacgcgcggacggggatcagccccgcgcgcgcgcacgtggcggccgccgacctggtgacggcgtacgagcagacggtgaaccaggagatcaacttccaaaaaagcttcaacaaccacgtgcgcacgctggtggcgcgcgaggaggtgaccatcggcctgatgcacctgtgggactttgtgagcgcgctggagcagaaccccaacagcaagcctctgacggcgcagctgttcctgatagtgcagcacagcagggacaacgaggcgttcagggacgcgctgctgaacatcaccgagcccgagggtcggtggctcctggacctgattaacatcttgcagagcatagtggtgcaggagcgcagcctgagcctggccgacaaggtggcggccatcaattactcgatgctcagtctgggcaagttttacgcgcgcaagatctaccagacgccgtacgtgcccatagacaaggaggtgaagatcgacggcttctacatgcgcatggcgctgaaggtgctgaccctgagcgacgacctgggcgtgtaccgcaacgagcgcatccacaaggccgtgagcgtgagccggcggcgcgagctgagcgaccgcgagctgatgcacagcctgcagcgggcgctggcgggggccggcagcggcgacagggaggccgagtcctacttcgaggcgggggcggacctgcgctgggtgcccagccggagggccctggaggccgcgggggcccgccgcgaggactatgcagacgaggaggaggaggatgacgaggagtacgagctagaggagggcgagtacctggactaaaccgcaggtggtgtttttggtagatgcaagacccgaacgtggtggacccggcgctgcgggcggctctgcagagccagccgtccggccttaactctacagacgactggcgacaggtcatggaccgcatcatgtcgctgacggcgcgcaatccggacgcgttccggcagcagccgcaggccaacaggctctccgccatcttggaggcggtggtgcctgcgcgcgcgaaccccacgcacgagaaggtgctggccatagtgaacgcgctggccgagaacagggccatccgcccggacgaggccgggctggtgtacgacgcgctgctgcagcgcgtggcccgctacaacagcggcaacgtgcagaccaacctggaccggctggtgggggacgtgcgcgaggcggtggcgcagcgggagcgcgcggagcggcagggaaacctgggctccatggtggcgctgaacgccttcctgagcacgcagccggccaacgtgccgcgggggcaggaggactacaccaactttgtgagcgcgctgcggctgatggtgaccgagaccccccagagcgaggtgtaccagtcggggccggactactttttccagaccagcagacagggcctgcagacggtgaacctgagccaggctttcaagaacctgcgggggctgtggggcgtgaaggcgcccaccggggaccgggcgacggtgtccagcctgctgacccccaactcgcgcctgctgctgctgctgatcgcgccgttcacggacagcggcagcgtgtcccgggagacctacctcgggcacctgctgacgctgtaccgcgaggccatcgggcagacccaggtggacgagcacaccttccaggagatcaccagcgtgagccgcgcgctggggcaggaggacacgggcagcctggaggcgaccctgaactacctgctgaccaaccggcggcagaagatcccctcgctgcatagtttgaccaccgaggaggagcgcatcctgcgctacgtgcagcagagcgtgagcctgaacctgatgcgcgacggggtgacgcccagcgtggcgctggacatgaccgcgcgcaacatggaaccgggcatgtacgccgcgcatcggccttacatcaaccgcctgatggactacttgcatcgcgcggcggccgtgaaccccgagtacttcaccaacgccatcctgaacccgcactggctcccgccgcccgggttctacagcgggggcttcgaggtccccgaggccaacgacggcttcctgtgggacgacatggacgacagcgtgttctccccgcggccgcaggcgctggcggaggcgtcgctgctacgcctccccaaaaaggaagagagccgccggcccagcagcgcggcggcctctctgtccgagctgggggcggcggccgcgcggcccgggtccctggggggcagcccctttcccagcctggtggggtctctgcagagcgggcgcaccacccggccccggctgctgggcgaggacgagtacctgaacaactccctgatgcagccggtgcgggagaaaaacctgccccccgccttccccaacaacgggatagagagcctggtagacaagatgagcagatggaagacctatgcgcaggagcacagggacttgcccgtgctccgcccgcccacgcggcgccagcgccacgaccggcagcgggggctggtgtgggatgacgaggactccgcggacgatagcagcgtgctggacctgggggggagcggcggtaacccgttcgcgcacctgcgcccccgcctggggaggatgtttcaataagaaaaatcaagcatgatgcaaggttttttaagcggataaataaaaaactcaccaaggccatggcgaccgagcgttgttggtttcttgttgtgttcccttagtatgcggcgcgcggcgatgtaccacgagggacctcctccctcttatgagagcgtggtgggcgcggcggcggcctctccctttgcgtcgcagctggagccgccgtacgtgcctccgcggtacctgcggcctacggggggaagaaacagcatccgttactcggagctggcgcccctgtacgacaccacccgggtgtacctggtggacaacaagtcggcggacgtggcctccctgaactaccagaacgaccacagcaattttttgaccacggtcatccagaacaatgactacaccccgagcgaggccagcacccagaccatcaatctggatgaccggtcgcactggggcggcgacctgaaaaccatcctgcacaccaacatgcccaacgtgaacgagttcatgttcaccaataagttcaaggcgcgggtgatggtgtcgcgttcgcacaccaaggacgaccgggtggagctgaagtacgagtgggtagagttcgagctgcccgagggcaactactcggagaccatgaccatagacctgatgaacaacgcgatcgtggagcactatctgaaagtgggcaggcagaacggggtcctggagagcgacatcggggtcaagttcgacaccaggaacttccgcctggggctggacccggtcaccgggctggtcatgcccggggtctacaccaacgaggccttccaccccgacatcatcctgctgcccggctgcggggtggacttcacctacagccgcctgagcaacctgctgggcatccgcaagcggcagcccttccaggagggctttaggatcacctacgaggacctggaggggggcaacatccccgcgctcctggatgtggaggcctaccagaatagcttgaaggaagaagaggcgggagagggcagcggcggcggcggcggcggtcaggaggagggcggggcctcctctgaggcctctgcggacgcagctgccgccgaggcggaggcggccgaccccgcgatggtggtagaggaagagaaggatatgaatgacgaggcggtgcgcggcgacacctttgccacccggggggaggagaagaaagcggaggccgaggccgcggcagaggaggcggcagcagcggcggcggcagtagaggcggcggccgaggcggagaagccccccaaggagcccgtgattaagcccctgaccgaagatagcaagaagcgcagttacaacgtgctcaaggacagcaccaacaccgagtaccgcagctggtacctggcctacaactacggcgacccggcgacgggggtgcgctcctggaccctgctgtgtacgccggacgtgacctgcggctcggagcaggtgtactggtcgctgcccgacatgatgcaagaccccgtgaccttccgctccacgcggcaggtcagcaacttcccggtggtgggcgccgagctgctgcccgtgcactccaagagcttctacaacgaccaggccgtctactcccagctcatccgccagttcacctctctgacccacgtgttcaatcgctttcctgagaaccagattctggcgcgcccgcccgcccccaccatcaccaccgtcagtgaaaacgttcctgctctcacagatcacgggacgctaccgctgcgcaacagcatcggaggagtccagcgagtgaccgtaactgacgccagacgccgcacctgtccctacgtttacaaggccctgggcatagtctcgccgcgcgtcctttccagccgcactttttaagcatgtccatcctcatctcgcccagcaataacaccggctggggcctgctgcgcgcgcccagcaagatgttcggaggggcgaggaagcgctccgaccagcaccccgtgcgcgtgcgcgggcactaccgcgccccctggggcgcgcacaaacgcggacgcaccggcaccgcggggcgcaccaccgtggacgaagccatcgactcggtggtggagcaggcgcgcaactacacgcccgcggtctccaccgtggacgcggctatcgagagcgtggtgcgaggcgcgcggcggtacgccaaggcgaagagccgccggaggcgcgtggcccgccgccaccgccgccgacccgggagcgccgccaagcgcgccgccgccgccttgcttcgtcgggccagacgcacgggccgccgcgccgccatgagggccgcgcgccgcctggccgccggcatcaccaccgtggccccccgcgccagaagacgcgcggccgccgccgccgccgcggccatcagcgacctggccaccaggcgccggggcaacgtgtactgggtgcgcgactcggtgagcggcacgcgcgtgcccgtgcgcttccgccccccgcggacttgagaggagaggacaggaaaaaagcatcaacaacaacaccactgagtctcctgctgttgtgtgtatcccagcggcgcgcgcgcacacggcgacatgtccaagcgcaaaatcaaagaagagatgctccaggtcgtcgcgccggagatctatgggcccccgaagaaggaagagcaggatttcaagccccgcaagataaagcgggtcaaaaagaaaaagaaagatgacgatgatggcgaggtggagtttctgcgcgccacggcgcccaggcgcccgctgcagtggaagggtcggcgcgtaaagcgcgttctgcgccccggcaccgcggtggtcttcacgcccggcgagcgctccacccgcactttcaagcgcgtctatgacgaggtgtacggcgacgaagacctgctggagcaggccaacgatcgctccggagagtttgcttacgggaagcggcaccgggcgatggagaaggacgaggtgctggcgctgccgctggaccggggcaaccccacccccagcctgaagcccgtgaccctgcagcaggtgctgccgagcagcgcgccctccgagatgaagcggggcctgaagcgcgagggcggcgacctggcgcccaccgtgcagctgatggtgcccaagcggcagaggctggaggacgtgctggagaaaatgaaagtagaccccggcctgcagccggacatcagggtccgccccatcaagcaggtggcgccgggcctcggcgtgcagaccgtggacgtggtcatccccaccggcgcctcctcttccagcgccgccgccgccgccactagcaccgcggacatggagacgcagactagctcctccctcgtcgcccccgcggccgccgccgccgccacctcctcggcggaggtacagacggacccctggatgccgccgccggcggccgctccctcgcgcgcacgccgcgggcgcaggaagtacggtgccgccagcgcgctcatgcccgagtatgccttgcatccttccatcgcgcccacccccggctaccgaggctacagctaccgcccgcgaagagccaagggctccacccgccgcagccgccgcgccgccacctctacccgccgccgcagtcgccgccgccgccgccggcagcccgcgctggctccgatctccgtgaggagagtggcgcgcgacggggacaccttggtgctgcccagggcgcgctaccaccccagcatcgtttaaaagcctgttgtggttcttgcagatatggccctcacttgccgcctccgtttcccggtgccgggataccgaggaagatcgcgccgtagaaggggtatggccggacgcggcctgagcggaggcagccgccgtgcgcaccggcggcgacgcgccaccagccgacgcatgcgcggcggggtgctgcctctgctgatccccctgatcgccgcggcgatcggcgccgtgcccgggatcgcctccgtggccttgcaggcgtcccagaggcgttgacacagacttcttgcaagcttgcaaaatatggaaaaaatccccccaataaaaaagtctagactctcacgctcgcttggtcctgtgactattttgtagaaaaaagatggaagacatcaactttgcgtcgctggccccgcgtcacggctcgcgcccgttcctgggacactggaacgatatcggcaccagcaacatgagcggtggcgccttcagttggggctctctgtggagcggcattaaaaatatcggttctgccgttaagaattacggcaccaaggcctggaacagcagcacgggccagatgttgagagacaagttgaaagagcagaacttccagcagaaggtggtggagggcctggcctccggcatcaacggggtggtggacctggccaatcaggccgtgcaaaataagatcaacagcagactggacccccggccgccggtggaagagctgccgccggcgctggagacggtgtcccccgatgggcggggcgaaaagcgcccgcggcccgacagggaagagaccactctggtcacgcacaccgatgagccgcccccctacgaggaagccctgaagcaaggcttgcccaccactcggcccatcgcgcccatggccaccggggtggtgggccgccacacccccgccacgctggacctgcctcctcctcctgtttcttcttcggccgccgatgcgcagcagcagaaggcggcgctgcccggtccgcccgcggccgccccccgtcccaccgccagtcgagcgcccctgcgtcgcgcggccagcggcccccgcggggtcgcgaggcacagcagcggcaactggcagaacacgctgaacagcatcgtgggtctgggggtgcagtccgtgaagcgccgccgatgctactgaatagcttagctaacggtgttgtatgtgtgtatgcgtcctatgtcaccgccagaggagctgctgagtcgccgccgttcgcgcgcccaccgccactaccaccgccggtaccactccagcgcccctcaagatggcgaccccatcgatgatgccgcagtggtcgtacatgcacatctcgggccaggacgcctcggagtacctgagccccgggctggtgcagttcgcccgcgccaccgacagctacttcagcctgagtaacaagtttaggaaccccacggtggcgcccacgcacgatgtgaccaccgaccggtcccagcgcctgacgctgcggttcatccccgtggaccgcgaggacaccgcgtactcttacaaggcgcggttcaccctggccgtgggcgacaaccgcgtgctggacatggcctccacctactttgacatccgcggcgtgctggacaggggccccaccttcaagccctactccggcaccgcctacaactccctggcccctaagggcgcccccaactcctgcgagtgggagcaattagaagaagcccaggccgctttggaagacgaagaattagaagaagacgaggaaccacaagatgaggcgcctgtgaaaaagacccatgtatacgctcaggcgcccctttctggagaacaaattactaaagacggtctgcaaatagggtcagataacacagaagctcagtctaagcctatatatgcagatcctacattccagcctgaacctcaaattggggaatcccaatggaatgaagcagatgctacagcagctgggggtagagtgctgaaaaaaaccactcctatgaagccatgctatggctcatatgcccgccctacaaactctaatggaggtcagggtgtgctggtggctgatgataagggcgtccttcaatctaaagttgaaatgcaatttttttcaaccactactacgcttaatcagcgggcgggtaatgatacaaaaccaaaactagtgctgtacagcgaggatgtgcacatggaaactccagacacacacatctcttacaagcctacaaaaagcgatgataattcgaaagtcatgctgggtcaacagtccatgcccaacaggcccaattacatcgccttcagagacaactttatcgggctcatgtattataacagcactggcaacatgggggtgctggcaggtcaggcctcacagttgaatgcagtggtggacctgcaagacagaaacacagaactgtcctaccagctcttgcttgattccatgggagacagaaccagatacttttccatgtggaatcaggcggtggacagttatgacccagatgtcagaatcattgaaaatcatggaactgaagatgagctgcccaactattgtttccctctgggaggcataggggtaactgacacttaccaggctattaaaactaatggcaatggtcaaggagacccaacctgggaaaaagacacagagtttgcagaccgcaacgagataggggtgggaaacaacttcgccatggagatcaacctcagtgccaacctgtggaggaacttcctctactccaacgtggccctgtacctgccagacaagcttaagtacaacccctccaacgtggaaatctctgacaaccccaacacctacgactacatgaacaagcgagtggtggccccggggctggtggactgctacatcaacctgggcgcgcgctggtccctggactacatggacaacgtcaaccccttcaaccaccaccgcaacgcgggcctgcgctaccgctccatgcttctgggcaacgggcgctacgtgcccttccacatccaggtgccccagaagttctttgccatcaagaacctcctcctcctgccgggctcctacacctacgagtggaactttaggaaggatgtcaacatggtcctccagagctctctgggtaacgacctcagggtcgacggggccagcatcaagttcgagagcatctgcctctacgccaccttcttccccatggcccacaacacggcctccacgctcgaggccatgctcaggaacgacaccaacgaccagtccttcaacgactacctctccgccgccaacatgctctaccccatccccgccaacgccaccaacgtccccatctccatcccctcgcgcaactgggcggccttccgcggctgggccttcacccgcctcaagaccaaggagaccccctccctgggctcgggtttcgacccctactacacctactcgggctccataccctacctggacggaaccttctacctcaaccacactttcaagaaggtctcggtcactttcgactcctcggtcagctggccgggcaacgaccgcctgctcacccccaacgagttcgagatcaagcgctcggtcgacggggagggctacaacgtggcccagtgcaacatgaccaaggactggttcctcatccaaatgctggccaactacaacatcggctatcagggcttctacatcccagagagctacaaggacaggatgtactccttctttaggaacttccagcccatgagccggcaggtggtggacgaaaccaagtacaaggactaccagcaggtgggcatcatccaccagcacaacaactcgggcttcgtgggctacctcgcccccaccatgcgcgagggacaggcctaccccgccaacttcccctacccgctcattggcaagaccgcggtcgacagcatcacccagaaaaagttcctctgcgaccgcaccctctggcgcatccccttctccagcaacttcatgtccatgggtgcgctcacggacctgggccagaacctgctctatgccaactccgcccacgcgctcgacatgaccttcgaggtcgaccccatggacgagcccacccttctctatgttctgttcgaagtctttgacgtggtccgggtccaccagccgcaccgcggcgtcatcgagaccgtgtacctgcgcacgcccttctcggccggcaacgccaccacctaaagaagcaagccgccaccgccatcacctgcatgtcgtcgggttccaccgagcaggagctcaaggccatcgtcagagacctgggatgcgggccctattttttgggcaccttcgacaaacgcttcccgggcttcgtcgccccgcacaagctggcctgcgccatcgtcaacacggccggccgcgagaccgggggcgtgcactggctggccttcgcctggaacccgcgctccaaaacatgctacctctttgaccccttcggattctcggaccagcggctcaagcagatctaccagttcgagtacgagggcctgctgcgccgcagcgccatcgcctcctcgcccgaccgctgcgtcaccctcgagaagtccacccagaccgtgcaggggcccgactcggccgcctgcggtctcttctgctgcatgttcctgcatgcctttgtgcgctggccccagagtcccatggaccgcaaccccaccatgaacttgctgacggggatccccaactccatgctccagagcccccaggccgcgcccaccctgcgccgcaaccaggagcgactctacagcttcctggaacgccactcgccctacttccgccgccacagcgcgcagatcaggggggccacctctttctgccgcatgcaagagatgcaagggaaaatgcaatgatgtacacagacactttttcttttctcaataaatggcaactttatttatacatgctctctctcgggtattcatttccccaccacccaccacccgccgccgccgtaaccatctgctgctggcttttttaaaaatcgaaagggttctgccgggaatcgccgtgcgccacgggcagggacacgttgcggaactggtagcgggtgccccacttgaactcgggcaccaccatgcggggcaagtcggggaagttgtcggcccacaggccgcgggtcagcaccagcgcgttcatcaggtcgggcgccgagatcttgaagtcgcagttggggccgccgccctgcgcgcgcgagttgcggtacaccgggttgcaacactggaacaccagcagcgccggataattcacactggccagcacgctccggtcggagatcagctcggcgtccaggtcctccgcgttgctcagcgcgaacggggtcagcttgggcacctgccgccccaggaagggagcgtgccccggcttggaattgcagtcgcagcgcagcgggatcagcaggtgcccgcggccggactcggcgttggggtacagcgcgcgcatgaaggcctccatctggcggaaggccatctgggccttggcgccctccgagaaaaacatgccgcaggacttgcccgagaactggttcgcggggcagctagcgtcgtgcaggcagcagcgcgcgtcggtgttggcgatctgcaccacgttgcgcccccaccggttcttcacgatcttggccttggaagcctgctccttcagcgcgcgctgcccgttctcgctggtcacatccatctcgatcacgtgctccttgttcaccatgctgctgccgtgcagacacttcagctcgccctccacctcggtgcagcggtgctgccacagcgcgcagcccgtgggctcgaaatgcttgtaggtcacctccgcgtaggactgcaggtaggcctgcaggaagcgccccatcatggtcacgaaggtcttgttgctgctgaaggtcagctgcagcccgcggtgctcctcgttcagccaggccttgcacacggccgccagcgcctccacctggtcgggcagcatcttgaagttcagcttcagctcattctccacatggtacttgtccatcagcgcgcgcgcagcctccatgcccttctcccaggccgacaccagcggcaggctcaaggggttcaccaccgtcgcagtcgccgccgcgctttcgctttccgctccgctgttctcttcttcctcctcctcctcctcttcttcctcgccgcccgcgcgcagcccccgcaccacggggtcgtcttcctgcaggcgccgcaccgagcgcttgccgctcctgccctgcttgatgcgcacgggcgggttgctgaagcctaccatcaccagcgcggcctcttcttgctcgtcctcgctgtccactatgacctcgggggagggcgacctcagtaccgtggcgcgctgcctcttctttttcctgggggcgtttgcaagctccgcggccgcggccgccgccgaggtcgaaggccgagggctgggcgtgcgcggcaccagcgcgtcctgcgagccgtcctcgtcctcggactcgaggcggcagcgagcccgcttcttcgggggcgcgcggggcggcggcggcgggggcggcggcgacggagacggggacgagacatcgtccagggtgggaggacggcgggccgcgccgcgtccgcgctcgggggtggtttcgcgctggtcctcttcccgactggccatctcccactgctccttctcctataggcagaaagagatcatggagtctctcatgcaagtcgagaaggaggaggacagcctaaccaccaccgccccctctgagccctccgccgccaccgccgcggacgacgcgcccaccaccgccgccaccaccaccaccattaccaccctacccggcgacgcagccccgatcgagaaggaagtgttgatcgagcaggacccgggttttgtgagcgaagaggaggatgaggaggatgaaaaggagaaggataccgccgcctcagtgccaaaagaggataaaaagcaagaccaggacgacgcagagacagatgaggcagcagtcgggcggggggacggaaggcatgatgatgatgacggctacctagacgtgggaaacgacgtgctgcttaagcacctgcaccgccagtgcgttatcgtctgcgacgcgctgcaggagcgctgcgaagtgcccctggacgtggcggaggtcagccgcgcctacgagcggcacctcttcgcgccacacgtgccccccaagcgccgggagaacggcacctgcgagcccaacccgcgcctcaacttctacccggtcttcgcggtacccgaggtgctggccacctaccacatcttcttccaaaactgcaagatccccctctcctgccgcgccaaccgcacccgcgccgacaaggcgctggccctgcggcagggcgcccacatacctgatatcgcctctctggaggaggtgcccaagatcttcgagggtctcggtcgcgacgagaaacgggcggcgaacgctctgcaaggagacagcgaaaacgagagtcactcgggggtgctggtggagctcgagggcgacaacgcgcgcctggccgtgctcaagcgcagcatcgaagtcacccacttcgcctacccggcgctcaacctgccccccaaggtcatgagtgtggtcatgagcgagctcatcatgcgccgcgcccagcccctggacgcggatgcaaacttgcaagagccctccgaggaaggcctgcccgcggtcagcgacgagcagctggcgcgctggctggagacccgcgaccccgcccagctggaggagcggcgcaagctcatgatggccgcggtgctcgtcaccgtggagctcgagtgtctgcagcgcttcttcggggaccccgagatgcagcgcaagctggaggagaccctgcactacaccttccgccagggctacgtgcgccaggcctgcaagatctccaacgtggagctctgcaacctggtctcctacctgggcatcctgcacgagaaccgcctcgggcagaacgtcctgcactccaccctcaaaggggaggcgcgccgcgactacgtccgcgactgcgtctacctcttcctctgctacacgtggcagacagccatgggggtctggcagcagtgcctggaggagcgcaaccttaaggagctggagaagctcctcaggcgcgccctcagggacctctggacgggcttcaacgagcgctcggtggccgccgcgctggcggacatcatcttccccgagcgcctgctcaaaaccctgcagcagggcctgcccgacttcaccagccagagcatgctgcagaacttcaggaccttcatcctggagcgctcgggcatcttgccggccacctgctgcgcgctgcccagcgacttcgtgcccatcaggtacagggagtgcccgccgccgctctggggccactgctacctcttccagctggccaactacctcgcctaccactcggatctcatggaagacgtgagcggcgagggcctgctcgagtgccactgccgctgcaacctgtgcacgccccaccgctctctagtctgcaacccgcagctgctcagcgagagtcagattatcggtaccttcgagctgcagggtccctcgcccgacgaaaagtccgcggctccggggttgaaactcactccggggctgtggacttccgcctacctacgcaaatttgtacctgaagactaccacgcccacgagatcaggttttacgaagaccaatcccgcccgcccaaggcggagctcaccgcctgcgtcattacccagggccacatcctgggccaattgcaagccatcaacaaagcccgccaagagttcttgctgaaaaagggtcggggggtgtacctggacccccagtccggcgaggagctaaacccgctacccccgccgccgccccagcagcgggaccttgcttcccaggatggcacccagaaagaagcagccgccgccgccgccagcatacatgcttctggaggaagaggaggactgggacagtcaggcagaggaggtttcggacgaggacgaggaggaggagatgatggaagactgggaggaggacagcctagacgaggaagcttcagaggccgaagaggtggcagacgcaacaccatcaccctcggccgcagccccctcgccggcgcccccgaaatcctccgaccccagcagcagcgctataacctccgctcctccggcgccggcgcccacccgcagcagacccaaccgtagatgggacactacaggaaccggggtcggtaagtccaagtgccccccagcgccgcccccgcaacaggagcaacagcagcagcagcggcgacagggctaccgctcgtggcgcggacacaagaacgccatagtcgcctgcttgcaagactgcgggggcaacatctccttcgcccgccgcttcctgctcttccaccacggggtggcttttccccgcaatgtcctgcattactaccgtcatctctacagcccctactgcggcggcagcggcgacccagagggagcggcggcagcagcagcgccagccacagcggcgaccacctaggaagacctccgcgggcaagacggcgggagccgggagacccgcggcggcggcggtagcggcggcggcgggcgcactgcgcctctcgcccaacgaacccctctcgacccgggagctcagacacaggatcttccccactctgtatgctatcttccagcagagcagaggccaggaacaggagctgaaaataaaaaacagatctctgcgctccctcacccgcagctgtctgtatcacaaaagcgaagatcagcttcggcgcacgctggaggacgcggaggcactcttcagcaaatactgcgcgctgactcttaaggactagccgcgcgcccttctcgaatttaggcgggagaaagactacgtcatcgccgaccgccgcccagcccacccagccgacatgagcaaagagattcccacgccctacatgtggagctaccagccgcagatgggactcgcggcgggagcggcccaagactactccacccgcatgaactacatgagcgcggggccccacatgatctcacgggttaatgggatccgcgccgagcgaaaccaaatactgctggaacaggcggccataaccgccacaccccgtcatgacctcaatccccgaaattggcccgccgccctcgtgtaccaggaaaccccctctgccaccaccgtggtacttccgcgtgacacccaggccgaagtccagatgactaactcaggggcgcagctcgcgggcggctttcgtcacggggtgcggccgcaccggccgggtatattacacctggcgatcagaggccgaggtattcagctcaacgacgagtcggtgagctcttcgctcggtctccgtccggacggaaccttccagatcgccggatcaggtcgctcctcattcacgcctcgccaggcgtacctgactctgcagacctcctcctcggagcctcgctccggcggcatcggcaccctccagttcgtggaggagttcgtgccctcggtctacttcaaccccttctcgggacctcccggacgctaccccgaccagttcatcccgaactttgacgcggtgaaggactcggcggacggctacgactgaatgtcaagtgctgaggcagagagcgttcgcctgaaacacctcgagcactgccgccgcttcgcctgctttgcccgcagctccggtgagttctgctactttcagctgcccgaggagcataccgaggggccggcgcacggcgtccgcctaaccacccagggcgaggttacctgtacccttatccgggagtttaccctccgtcccctgctagtggagcgggagcggggttcttgtgttataactatcgcctgcaactgccctaaccctggattacatcaagatctttgttgtcacctgtgcgctgagtataataaacgctgagatcagactctactggggctcctgtcgccatcctgtgaacgccaccgtcttcacccaccccgagcagccccaggcgaacctcacctgcggcctgcgtcggagggccaagaagtacctcacctggtacttcaacggcaccccctttgtggtttacaacagcttcgaccaggacggagttgccttgagagacgacctttccggtctcagctactccattcacaagaacaccaccctccacctcttccctccctacctgccgggaacctacgagtgcgtcaccggccgctgcacccacctcctccgcctgatcgtaaaccagacctttccgggaacacacctcttccccagaacaggaggtgagctcaggaaaccccctggggcccagggcggagacttaccttcgacccttgtggggttaggattttttatcgccgggttgctggctctcctgatcaaagcttccttcagatttgttctctccctttacttttatgaacagctcaacttctaataacactaccttttctcaggaatcgggtagtaacttctcttctgaaatcgggctgggtgtgctgcttactctgttgatttttttccttatcatacttagccttctgtgcctcaggctcgccgcctgctgcgcacatatctacatctacagccggttgcttaactgctggggtcgccatccaagatgaacggggctcaggtgctatgtctgctggccctggtggcctgcagtgccgccgtcaattttgaggaacccgcttgcaatgtgactttcaagcctgagggcgcacattgcaccactctggttaaatgtgtgacctctcatgaaaaactgctcatcgcctacaaaaacaaaacaggcgagttcgcggtctatagtgtgtggcaacccggagaccataataactactcagtcaccgtcttcgagggtgcggagtctaagaaattcgattacacctttccctttgaggagatgtgtgatgcggtcatgtacctgtccaaacagtacaagctgtggccccccacccccgaggcgtgtgtggaaaacactgggtctttctgctgtctctctctggcaatcactgtgcttgctctaatctgcacgctgctatacatgagattcaggcagaggcgaatctttatcgatgagaaaaaaatgccttgatcgctaacaccggctttctgtctgcagaatgaaagcaatcacctccctactaatcagcaccaccctccttgcgattgcccatgggttgacacgaatcgaagtgccagtggggtccaatgtcaccatggtgggccccgccggcaattcctccctgatgtgggaaaaatatgtccgtaatcaatgggatcattactgctctaatcgaatctgtatcaagcccagagccatctgcgacgggcaaaatctaactttgattgatgtgcaaatgacggatgctgggtactattacgggcagcggggagaaatgattaattactggcgaccccacaaggactacatgctgcatgtagtcaaggcagtccccactactaccacccccaccactaccactcccactactaccacccccactactaccactagcactgctactaccgctgcccgcaaagctattacccgcaaaagcaccatgcttagcaccaagccccattctcactcccacgccggcgggcccaccggtgcggcctcagaaaccaccgagctttgcttctgccaatgcactaacgccagcgcccacgaactgttcgacctggagaatgaggatgatgaccagctgagctccgcttgcccggtcccgctgcccgcagagccggtcgccctgaagcagatcggtgatccatttattgactctcctgtttatccctctcccgaataccctcccgactctaccttccacatcacgggcaccaacgaccccaacctctccttctacctgatgctgctgctttgtatctctgtggtatcttccgcgctcatgttactgggcatgttctgctgcctcatctgccgcagaaaaagaaagtctcgctctcagggccaaccactgatgcccttcccctaccccccagattttgcagataacaagatatgagcacgctgctgacactaaccgctttactcgcctgcgctctaacccttgtcgcttgcgaatccagataccacaatgtcacagttgtgacaggagaaaatgttacattcaactccacggccgacacccagtggtcgtggagcggccacggtagctatgtatacatctgcaatagctccacctcccctagcatgtcctctcccaagtaccactgcaatgccagtctgttcaccctcatcaacgcctccacctcggacaatggactctatgtaggctatgtgacacccggtgggcagggaaagacccacgcctacaacctgcaagttcgccacccctccaccaccgccaccacctctgccgcccctacccgcagcagcagcagcagcagcagcagcagcagattcctgactttaatcctagccagctcaacaaccaccgccaccgctgacaccacccacagctccgcgcccgaaaccacccacacccaccacccagagacgaccgcggcctccagcgaccagatgtcggccaacatcaccgcctcggatcttgaacttgcttcaacccccaccccaaaaccagtggatgcagccgacgtctccgccctcgtcaatgactgggcggggctgggaatgtggtggttcgccataggcatgatggcgctctgcctgcttctgctctggctcatctgctgcctcaaccgcaggcgggccagacccatctatagacccatcattgttctcaaccccgctgatgatgggatccatagattggatggtctgaaaaacctacttttctcttttacagtatgataaattgagacatgcctcgcattttcatgtacttgacacttctcccactttttctggggtgttctacgctggccgccgtctctcacctcgaggtagactgcctcacacccttcactgtctacctgatttacggattggtcaccctcactctcatctgcagcctaatcacagtagtcatcgccttcatccagtgcattgactacatctgtgtgcgcctcgcatacctgagacaccacccgcagtaccgagacagaaacattgcccaactcctaagactgctctaatcatgcataagactgtgatctgcctcctcatcctcctctccctgcccgctctcgtctcatgccagcccaccacaaaacctccacgaaaaagacatgcctcctgtcgcttgagccaactgtggaatattcccaaatgctacaatgaaaagagcgagctttccgaagcctggctatatgcggtcatgtgtgtccttgtcttctgcagcacaatctttgccctcatgatctacccccactttgatttgggatggaatgcggtcgatgccatgaattaccctacctttcccgcgcccgatatgattccactccgacaggttgtggtgcccgtcgccctcaatcaacgccccccatcccctacacccactgaggtcagctactttaatctaacaggcggagatgactgacactctagatctagaaatggacggcatcggcaccgagcagcgtctcctacagaggcgcaagcaggcggctgaacaagagcgcctcaatcaggagctccgagatctcattaacctgcaccagtgcaaaaaaggcatcttttgcctggtcaagcaggccgatgtcacctacgagaaaaccggtaacagccaccgcctcagctacaagctgcccacccaacgccagaagttggtgctcatggtgggtcagaatcccatcaccgtcacccagcactcggtggagaccgaggggtgtctgcactccccctgtcagggtccggaagacctctgcaccctggtaaagaccctgtgtggtcttagagatttaatcccctttaactaatcaaacactggaatcaataaaaagaatcacttactttaaatcagtcagcaggtctctgtccactttattcagcagcacctccttcccctcctcccaactctggtactccaaacgcctcctggcggcaaacttcctccacaccctgaagggaatgtcagattcttgctcctgtccctccgcacccactatcttcatgttgttgcagatgaagcgcgccaaaacgtctgacgagaccttcaaccccgtgtacccctatgacacggaaaacgggcctccctccgtccctttcctcacccctcccttcgtgtcccccgacggatttcaagaaagccccccaggggtcctgtctctgcgcctgtcagagcccctggtcacttcccacggcatgcttgccctgaaaatgggaaatggcctctccctggatgacgccggcaacctcacctctcaagatgtcaccaccgtcacccctcccctcaaaaaaaccaagaccaacctcagcctccagacctcagcccccctgaccgttagctctgggtccctcaccgtcgcggccgccgctccactggcggtggccggcacctctctcaccatgcaatctcaggcccccttgacagtgcaagatgcaaaactcggcctggccacccagggacccctgaccgtgtctgaaggcaaactcaccttgcagacatcggctccactgacggccgctgacagcagcactctcactgttagtgccacacctcccctcagcacaagcaatggtagtttgagcattgacatgcaggccccgatttataccaccaatggaaaactggcacttaacattggtgctcccctgcatgtggtagacaccctaaatgcactaactgtagtaactggccagggtcttaccataaatggaaaagccctgcaaactagagtcacgggtgccctcagttatgacacagaaggcaacatccaactgcaagccggagggggtatgcgcattgacaataatggccaacttatccttaatgtagcttatccatttgatgctcaaaacaacctcagccttagacttggccaaggccccctaattgttaactctgcccacaacttggatcttaaccttaacagaggcctttacttatttacatctggaaacacgaaaaaactggaagttaacataaaaacagccaaaggtctattttacgatggcaccgctatagcaatcaatgcaggtgacgggctacagtttgggtctggttcagatacaaatccattgcaaactaaacttggattggggctggaatatgactccaacaaagctataatcaccaaacttggaactggcctaagctttgacaacacaggtgccatcacagtaggcaacaaaaatgatgacaagcttaccttgtggaccacaccagacccctccccaaactgcagaattaattcagaaaaagatgctaaactcacactagttttgactaaatgcggcagccaggtgttagccagcgtttctgttttatctgtaaaaggcagccttgcccccatcagcggcacagtaactagcgcccagattgttttaagatttgatgaaaacggagttttattgagcaattcttctcttgacccccaatactggaactatagaaaaggcgattctacagaaggcactgcatatactaatgctgtgggatttatgcccaacctcacagcataccctaaaacacagagccagactgctaaaagcaacattgtaagtcaagtttacttgaatggggacaaaacaaaacccatgaccctaaccatcaccctcaatggaactaatgaaacaggggatgctacagtaagcacatactccatgtcattttcatggaactggaatggaagtaattacattaatgacaccttccaaaccaactcctttaccttctcctacatcgcccaagaataaaaaagcatgacgctttgttctctgattcagtgtgtttcttttattttttttcaattacaacagaatcattcaagtcattctccatttagcttaatagacccagtagtgcaaagccccatactagcttatttcagacagtataaattaaaccataccttttgatttcaatattaaaaaaatcatcacaggatcctagtcgtcaggccgccccctccctgccaagacacagaatacacaatcctctccccccggctggctttaaacaacaccatctggttggtgacagacaggttcttcggggttatattccacacggtctcctggcgggccaggcgctcgtcggtgatgctgataaactctcccggcagctcgctcaagttcacgtcgctgtccagcggctgaacctcatgctgacgcggtaactgcgcgaccggctgctgaacaaacggaggccgcgcctacaagggggtagagtcatagtcctccgtcaggatagggcggttatgcagcagcagcgagcgaatcatctgctgccgccgccgctccgtccggcaggaaaacaacatcccggtggtctcctccgctataatccgcaccgcccgcagcataagcctcctcgttctccgcgcacagcaccgcaccctgatctcgctcaggttggcgcagtaggtacagcacatcaccacgatgttattcatgatcccacagtgcaaggcgctgtatccaaagctcatgcccggaaccaccgcccccacgtgaccgtcgtaccagaagcgcaggtaaatcaagtgccgacccctcatgaacgtgctggacataaacatcacctccttgggcatgttgtaattcaccacctcccggtaccagatgaatctctgattgaacacggccccttccaccaccatcctgaaccaagaggctaggacctgcccaccggctatgcactgcagggaacccgggttggaacaatgacaatgcagactccagggctcgtaaccgtggatcatccggctgctgaagacatcgatgttggcgcaacacagacacacgtgcatacacttcctcatgattagcagctcctccctcgtcaggatcatatcccaagggataacccattcttgaatcaacgtaaagcccacagagcagggaaggcctcgcacataactcacgttgtgcatggtcagcgtgttgcattccggaaacagcggatgatcctccagtatcgaggcgcgggtctcgttctcacagggaggtaaaggggccctgctgtacggactgtggcgggacgaccgagatcgtgttgagcgtaacgtcatggaaaagggaacgccggacgtggtcatacttcttgaagcagaaccaggctcgcgcgtgacagacctccttgcgtctacggtctcgccgcttaactcgctccgtgtgatagttgtagtacagccactctctcaaagcgtcgaggcgacacctggcgtcaggatgtatgtagactccgtcttgcaccgcggccctgataatatccaccaccgtagaataagccacaccaagccaagcaatacactcgctttgcgagcggcagacaggaggagcggggagagacggaaggaccatcataaaattttaaagaatattttccaatacttcgaaatcaagatctaccaaatggcaacgctcccctccactggcgcggtcaaactctacggccaaagaacagataacggcatttttaagatgttcccggacggcgtctaaaagacaaaccgctctcaagtcgacataaattataagccaaaagccatcgggatccatatccactatggacgcgccggcggcgtccaccaaacccaaataattttcttctctccagcgctgcaaaatcccagtaagcaactccctgatattaagatgaaccatgccaaaaatctgttcaagagcgccctccaccttcattctcaagcagcgcatcatgattgcaaaaattcaggttcctcagacacctgtatgagattcaaaacgggaatattaacaaaaatttctctgtcgcgcagatcccttcgcagggcaagctgaacataatcagacaggtctgaacgaaccagcgaggccaaatccccgccaggaaccagatccagagaccctatgctgattatgacgcgcatactcggggctatgctaaccagcgtagcgccgatgtaggcgtgctgcatgggcggtgaaataaaatgcaaggtgctggttaaaaaatcaggcaaagcctcgcgcaaaaaagctaagacatcataatcatgctcatgcaggtagttgcaggtaagctcaggaaccaaaacggaataacacacgattttcctttcaaacatgacttccaggtgactgcataagaaaaaaaaattataaataataaatattaattaaataaattaaacattggaagcctgtctcacaacaggaaaaaccactctgatcaacataagacgggccacgggcatgcccgcgtgaccataaaaaaatcggtctccgtgattacaaagcaccacagatagctccccggtcatgtcgggggtcatcatgtgagactgtgtatacacgtccgggctgttgacatcggtcaaagaaagaaatcgagctacatagcccggaggaatcaacacccgcacgcggaggtacagcaaaacggtccccataggaggaatcacaaaattagtaggagaaaaaaaaacataaacaccagaaaaaccctcttgccgaggcaaaacagcgccctcccgttccaaaacaacataaagcgcttccacaggagcagccatgacaaagacccgagtcttaccaggaaaattttaaaaaagactcctcaacgcagcaccagcaccaacacctgtcagtgtaaaatgccaagcgccgagcgagtatatataggaataaaaagtgacgtaaacggttaaagtccagaaaacgcccagaaaaaccgcacgcgaacctacgccccgaaacgaaagccaaaaaacactaaacacgccctttcggcgtcaacttccggtttcccacggtacgtcacttccgcatatagtaaaactacgctacccaacatgcaagaagccacgccccaaaacacgtcacacctcccggcccgccccgcgccgccgctcctccccgccccgccccgctccgcccacctcattatcatattggcttcaatccaaaataaggtatattattgatgatg

SEQ ID NO: 34 - protein, 508 aa, Unknown
  Synthetic Construct
MERRDPLEFGIRPGFSGHTTVESMDQAQEQNATVVFRPSVADSAGGAADRAGGPGSSGTRREGARSGAGEERVEPGSRPERPSTSGVNVGQVADLFPELRRILTIREDGQFVKGLKRERGASEHNEEASNLAFSLMTRHRPECITFQQIKDNCANELDLLGQKYSIEQLTTYWLQPGDDLEEAIRVYAKVALRPDCKYKLKGLVNIRNCCYISGNGAEVEIETDDRVAFRCSMMNMWPGVLGMDGVVIMNVRFTGPNFNGTVFLGNTNLVLHGVSFYGFNNTCVEAWTDVKVRGCAFYGCWKAVVCRPKSRSSIKKCLFERCTLGVLAEGNCRVRHNVASECGCFMLVKSVAVIKHNMVCGNSEDKASQMLTCSDGNCHLLKTIHITSHSRKAWPVFEHNVLTRCSLHLGNRRGVFLPYQCNLSHTKVLLEPESMSKVNLNGVFDMTLKIWKVLRYDETRSRCRPCECGGKHMRNQPVMLDVTEELRPDHLVLACTRAEFGSSDEDTD

SEQ ID NO: 35 - protein, 147 aa, Unknown
  Synthetic Construct
MSGSSSSNALDGSIVSPYLTTRMPHWAGVRQNVMGSSIDGRPVLPANSATLTYATVAGTPLDATAAAAATAAASAVRSLATDFAFLGPLATGAAARAAVRDDKLTALLAQLDALTRELGDLSQQVVALRQQVSALQASGNASPANAV

SEQ ID NO: 36 - protein, 420 aa, Unknown
  Synthetic Construct
MHPVLRQMRPPPQQQQQQHQQERHQQQRESCRAPSPTLGGPATSASAAVSGAGGGGLADDPEEPPRRRARQYLDLEEGEGLARLGAPSPERHPRVQLKRDSREAYVPRQNLFRDRAGEEPEEMRDRRFAAGRELRQGLNRERLLREEDFEPDARTGISPARAHVAAADLVTAYEQTVNQEINFQKSFNNHVRTLVAREEVTIGLMHLWDFVSALEQNPNSKPLTAQLFLIVQHSRDNEAFRDALLNITEPEGRWLLDLINILQSIVVQERSLSLADKVAAINYSMLSLGKFYARKIYQTPYVPIDKEVKIDGFYMRMALKVLTLSDDLGVYRNERIHKAVSVSRRRELSDRELMHSLQRALAGAGSGDREAESYFEAGADLRWVPSRRALEAAGARREDYADEEEEDDEEYELEEGEYLD

SEQ ID NO: 37 - protein, 590 aa, Unknown
  Synthetic Construct
MQDPNVVDPALRAALQSQPSGLNSTDDWRQVMDRIMSLTARNPDAFRQQPQANRLSAILEAVVPARANPTHEKVLAIVNALAENRAIRPDEAGLVYDALLQRVARYNSGNVQTNLDRLVGDVREAVAQRERAERQGNLGSMVALNAFLSTQPANVPRGQEDYTNFVSALRLMVTETPQSEVYQSGPDYFFQTSRQGLQTVNLSQAFKNLRGLWGVKAPTGDRATVSSLLTPNSRLLLLLIAPFTDSGSVSRETYLGHLLTLYREAIGQTQVDEHTFQEITSVSRALGQEDTGSLEATLNYLLTNRRQKIPSLHSLTTEEERILRYVQQSVSLNLMRDGVTPSVALDMTARNMEPGMYAAHRPYINRLMDYLHRAAAVNPEYFTNAILNPHWLPPPGFYSGGFEVPEANDGFLWDDMDDSVFSPRPQALAEASLLRLPKKEESRRPSSAAASLSELGAAAARPGSLGGSPFPSLVGSLQSGRTTRPRLLGEDEYLNNSLMQPVREKNLPPAFPNNGIESLVDKMSRWKTYAQEHRDLPVLRPPTRRQRHDRQRGLVWDDEDSADDSSVLDLGGSGGNPFAHLRPRLGRMFQ

SEQ ID NO: 38 - protein, 581 aa, Unknown
  Synthetic Construct
MRRAAMYHEGPPPSYESVVGAAAASPFASQLEPPYVPPRYLRPTGGRNSIRYSELAPLYDTTRVYLVDNKSADVASLNYQNDHSNFLTTVIQNNDYTPSEASTQTINLDDRSHWGGDLKTILHTNMPNVNEFMFTNKFKARVMVSRSHTKDDRVELKYEWVEFELPEGNYSETMTIDLMNNAIVEHYLKVGRQNGVLESDIGVKFDTRNFRLGLDPVTGLVMPGVYTNEAFHPDIILLPGCGVDFTYSRLSNLLGIRKRQPFQEGFRITYEDLEGGNIPALLDVEAYQNSLKEEEAGEGSGGGGGGQEEGGASSEASADAAAAEAEAADPAMVVEEEKDMNDEAVRGDTFATRGEEKKAEAEAAAEEAAAAAAAVEAAAEAEKPPKEPVIKPLTEDSKKRSYNVLKDSTNTEYRSWYLAYNYGDPATGVRSWTLLCTPDVTCGSEQVYWSLPDMMQDPVTFRSTRQVSNFPVVGAELLPVHSKSFYNDQAVYSQLIRQFTSLTHVFNRFPENQILARPPAPTITTVSENVPALTDHGTLPLRNSIGGVQRVTVTDARRRTCPYVYKALGIVSPRVLSSRTF

SEQ ID NO: 39 - protein, 199 aa, Unknown
  Synthetic Construct
MSILISPSNNTGWGLLRAPSKMFGGARKRSDQHPVRVRGHYRAPWGAHKRGRTGTAGRTTVDEAIDSVVEQARNYTPAVSTVDAAIESVVRGARRYAKAKSRRRRVARRHRRRPGSAAKRAAAALLRRARRTGRRAAMRAARRLAAGITTVAPRARRRAAAAAAAAISDLATRRRGNVYWVRDSVSGTRVPVRFRPPRT

SEQ ID NO: 40 - protein, 374 aa, Unknown
  Synthetic Construct
MSKRKIKEEMLQVVAPEIYGPPKKEEQDFKPRKIKRVKKKKKDDDDGEVEFLRATAPRRPLQWKGRRVKRVLRPGTAVVFTPGERSTRTFKRVYDEVYGDEDLLEQANDRSGEFAYGKRHRAMEKDEVLALPLDRGNPTPSLKPVTLQQVLPSSAPSEMKRGLKREGGDLAPTVQLMVPKRQRLEDVLEKMKVDPGLQPDIRVRPIKQVAPGLGVQTVDVVIPTGASSSSAAAAATSTADMETQTSSSLVAPAAAAAATSSAEVQTDPWMPPPAAAPSRARRGRRKYGAASALMPEYALHPSIAPTPGYRGYSYRPRRAKGSTRRSRRAATSTRRRSRRRRRRQPALAPISVRRVARDGDTLVLPRARYHPSIV

SEQ ID NO: 41 - protein, 80 aa, Unknown
  Synthetic Construct
MALTCRLRFPVPGYRGRSRRRRGMAGRGLSGGSRRAHRRRRATSRRMRGGVLPLLIPLIAAAIGAVPGIASVALQASQRR

SEQ ID NO: 42 - protein, 259 aa, Unknown
  Synthetic Construct
MEDINFASLAPRHGSRPFLGHWNDIGTSNMSGGAFSWGSLWSGIKNIGSAVKNYGTKAWNSSTGQMLRDKLKEQNFQQKVVEGLASGINGVVDLANQAVQNKINSRLDPRPPVEELPPALETVSPDGRGEKRPRPDREETTLVTHTDEPPPYEEALKQGLPTTRPIAPMATGVVGRHTPATLDLPPPPVSSSAADAQQQKAALPGPPAAAPRPTASRAPLRRAASGPRGVARHSSGNWQNTLNSIVGLGVQSVKRRRCY

SEQ ID NO: 43 - protein, 957 aa, Unknown
  Synthetic Construct
MATPSMMPQWSYMHISGQDASEYLSPGLVQFARATDSYFSLSNKFRNPTVAPTHDVTTDRSQRLTLRFIPVDREDTAYSYKARFTLAVGDNRVLDMASTYFDIRGVLDRGPTFKPYSGTAYNSLAPKGAPNSCEWEQLEEAQAALEDEELEEDEEPQDEAPVKKTHVYAQAPLSGEQITKDGLQIGSDNTEAQSKPIYADPTFQPEPQIGESQWNEADATAAGGRVLKKTTPMKPCYGSYARPTNSNGGQGVLVADDKGVLQSKVEMQFFSTTTTLNQRAGNDTKPKLVLYSEDVHMETPDTHISYKPTKSDDNSKVMLGQQSMPNRPNYIAFRDNFIGLMYYNSTGNMGVLAGQASQLNAVVDLQDRNTELSYQLLLDSMGDRTRYFSMWNQAVDSYDPDVRIIENHGTEDELPNYCFPLGGIGVTDTYQAIKTNGNGQGDPTWEKDTEFADRNEIGVGNNFAMEINLSANLWRNFLYSNVALYLPDKLKYNPSNVEISDNPNTYDYMNKRVVAPGLVDCYINLGARWSLDYMDNVNPFNHHRNAGLRYRSMLLGNGRYVPFHIQVPQKFFAIKNLLLLPGSYTYEWNFRKDVNMVLQSSLGNDLRVDGASIKFESICLYATFFPMAHNTASTLEAMLRNDTNDQSFNDYLSAANMLYPIPANATNVPISIPSRNWAAFRGWAFTRLKTKETPSLGSGFDPYYTYSGSIPYLDGTFYLNHTFKKVSVTFDSSVSWPGNDRLLTPNEFEIKRSVDGEGYNVAQCNMTKDWFLIQMLANYNIGYQGFYIPESYKDRMYSFFRNFQPMSRQVVDETKYKDYQQVGIIHQHNNSGFVGYLAPTMREGQAYPANFPYPLIGKTAVDSITQKKFLCDRTLWRIPFSSNFMSMGALTDLGQNLLYANSAHALDMTFEVDPMDEPTLLYVLFEVFDVVRVHQPHRGVIETVYLRTPFSAGNATT

SEQ ID NO: 44 - protein, 211 aa, Unknown
  Synthetic Construct
MSSGSTEQELKAIVRDLGCGPYFLGTFDKRFPGFVAPHKLACAIVNTAGRETGGVHWLAFAWNPRSKTCYLFDPFGFSDQRLKQIYQFEYEGLLRRSAIASSPDRCVTLEKSTQTVQGPDSAACGLFCCMFLHAFVRWPQSPMDRNPTMNLLTGIPNSMLQSPQAAPTLRRNQERLYSFLERHSPYFRRHSAQIRGATSFCRMQEMQGKMQ

SEQ ID NO: 45 - protein, 831 aa, Unknown
  Synthetic Construct
MESLMQVEKEEDSLTTTAPSEPSAATAADDAPTTAATTTTITTLPGDAAPIEKEVLIEQDPGFVSEEEDEEDEKEKDTAASVPKEDKKQDQDDAETDEAAVGRGDGRHDDDDGYLDVGNDVLLKHLHRQCVIVCDALQERCEVPLDVAEVSRAYERHLFAPHVPPKRRENGTCEPNPRLNFYPVFAVPEVLATYHIFFQNCKIPLSCRANRTRADKALALRQGAHIPDIASLEEVPKIFEGLGRDEKRAANALQGDSENESHSGVLVELEGDNARLAVLKRSIEVTHFAYPALNLPPKVMSVVMSELIMRRAQPLDADANLQEPSEEGLPAVSDEQLARWLETRDPAQLEERRKLMMAAVLVTVELECLQRFFGDPEMQRKLEETLHYTFRQGYVRQACKISNVELCNLVSYLGILHENRLGQNVLHSTLKGEARRDYVRDCVYLFLCYTWQTAMGVWQQCLEERNLKELEKLLRRALRDLWTGFNERSVAAALADIIFPERLLKTLQQGLPDFTSQSMLQNFRTFILERSGILPATCCALPSDFVPIRYRECPPPLWGHCYLFQLANYLAYHSDLMEDVSGEGLLECHCRCNLCTPHRSLVCNPQLLSESQIIGTFELQGPSPDEKSAAPGLKLTPGLWTSAYLRKFVPEDYHAHEIRFYEDQSRPPKAELTACVITQGHILGQLQAINKARQEFLLKKGRGVYLDPQSGEELNPLPPPPPQQRDLASQDGTQKEAAAAAASIHASGGRGGLGQSGRGGFGRGRGGGDDGRLGGGQPRRGSFRGRRGGRRNTITLGRSPLAGAPEILRPQQQRYNLRSSGAGAHPQQTQP

SEQ ID NO: 46 - protein, 227 aa, Unknown
  Synthetic Construct
MSKEIPTPYMWSYQPQMGLAAGAAQDYSTRMNYMSAGPHMISRVNGIRAERNQILLEQAAITATPRHDLNPRNWPAALVYQETPSATTVVLPRDTQAEVQMTNSGAQLAGGFRHGVRPHRPGILHLAIRGRGIQLNDESVSSSLGLRPDGTFQIAGSGRSSFTPRQAYLTLQTSSSEPRSGGIGTLQFVEEFVPSVYFNPFSGPPGRYPDQFIPNFDAVKDSADGYD

SEQ ID NO: 47 - protein, 185 aa, Unknown
  Synthetic Construct
IKIFVVTCALSIINAEIRLYWGSCRHPVNATVFTHPEQPQANLTCGLRRRAKKYLTWYFNGTPFVVYNSFDQDGVALRDDLSGLSYSIHKNTTLHLFPPYLPGTYECVTGRCTHLLRLIVNQTFPGTHLFPRTGGELRKPPGAQGGDLPSTLVGLGFFIAGLLALLIKASFRFVLSLYFYEQLNF

SEQ ID NO: 48 - protein, 159 aa, Unknown
  Synthetic Construct
MNGAQVLCLLALVACSAAVNFEEPACNVTFKPEGAHCTTLVKCVTSHEKLLIAYKNKTGEFAVYSVWQPGDHNNYSVTVFEGAESKKFDYTFPFEEMCDAVMYLSKQYKLWPPTPEACVENTGSFCCLSLAITVLALICTLLYMRFRQRRIFIDEKKMP

SEQ ID NO: 49 - protein, 300 aa, Unknown
  Synthetic Construct
MKAITSLLISTTLLAIAHGLTRIEVPVGSNVTMVGPAGNSSLMWEKYVRNQWDHYCSNRICIKPRAICDGQNLTLIDVQMTDAGYYYGQRGEMINYWRPHKDYMLHVVKAVPTTTTPTTTTPTTTTPTTTTSTATTAARKAITRKSTMLSTKPHSHSHAGGPTGAASETTELCFCQCTNASAHELFDLENEDDDQLSSACPVPLPAEPVALKQIGDPFIDSPVYPSPEYPPDSTFHITGTNDPNLSFYLMLLLCISVVSSALMLLGMFCCLICRRKRKSRSQGQPLMPFPYPPDFADNKI

SEQ ID NO: 50 - protein, 90 aa, Unknown
  Synthetic Construct
MPRIFMYLTLLPLFLGCSTLAAVSHLEVDCLTPFTVYLIYGLVTLTLICSLITVVIAFIQCIDYICVRLAYLRHHPQYRDRNIAQLLRLL

SEQ ID NO: 51 - protein, 133 aa, Unknown
  Synthetic Construct
MHKTVICLLILLSLPALVSCQPTTKPPRKRHASCRLSQLWNIPKCYNEKSELSEAWLYAVMCVLVFCSTIFALMIYPHFDLGWNAVDAMNYPTFPAPDMIPLRQVVVPVALNQRPPSPTPTEVSYFNLTGGDD

SEQ ID NO: 52 - protein, 577 aa, Unknown
  Synthetic Construct
MKRAKTSDETFNPVYPYDTENGPPSVPFLTPPFVSPDGFQESPPGVLSLRLSEPLVTSHGMLALKMGNGLSLDDAGNLTSQDVTTVTPPLKKTKTNLSLQTSAPLTVSSGSLTVAAAAPLAVAGTSLTMQSQAPLTVQDAKLGLATQGPLTVSEGKLTLQTSAPLTAADSSTLTVSATPPLSTSNGSLSIDMQAPIYTTNGKLALNIGAPLHVVDTLNALTVVTGQGLTINGKALQTRVTGALSYDTEGNIQLQAGGGMRIDNNGQLILNVAYPFDAQNNLSLRLGQGPLIVNSAHNLDLNLNRGLYLFTSGNTKKLEVNIKTAKGLFYDGTAIAINAGDGLQFGSGSDTNPLQTKLGLGLEYDSNKAIITKLGTGLSFDNTGAITVGNKNDDKLTLWTTPDPSPNCRINSEKDAKLTLVLTKCGSQVLASVSVLSVKGSLAPISGTVTSAQIVLRFDENGVLLSNSSLDPQYWNYRKGDSTEGTAYTNAVGFMPNLTAYPKTQSQTAKSNIVSQVYLNGDKTKPMTLTITLNGTNETGDATVSTYSMSFSWNWNGSNYINDTFQTNSFTFSYIAQE

SEQ ID NO: 53 - DNA, 660 bp, Unknown
  Simian adenovirus 42.1
  CDS (7)..(657): E1b\19K
gagataatgtttaattgcatggtgtgtttgattggggcggggtttgttgggtatataagcttccctgggctaaacttggttacacttgacctcatggaggcctgggagtgtttagagagctttgccgaagtgcgtgccttgctggaagagagctctaataatacctctgggtggtggaggtatttttggggctctccccaggctaagttagtttgtagaatcaaggaggattacaagtgggaatttgaacagcttttgaaatcctgtggtgagctcttggattctttgaatctgggccaccaggctcttttccaggacaagatcatcaggactttggatttttccacaccggggcgcattgctgctggggttgcttttctagcttttttgaaggataaatggagcgaagagacccacttgagttcgggatacgtcctggattttctggccatacaactgtggagagcatggatcaggcacaagaacagaatgcaactgttgtcttccgtccgtccgttgctgattcagccggaggagcagcagaccgggccggaggaccgggctcgtctggaaccagaagagagggcgcccgcagcggcgccggagaggagcgcgtggaacctgggagccggcctgaacggccatccacatcgggagtga

SEQ ID NO: 54 - protein, 217 aa, Unknown
  Synthetic Construct
MFNCMVCLIGAGFVGYISFPGLNLVTLDLMEAWECLESFAEVRALLEESSNNTSGWWRYFWGSPQAKLVCRIKEDYKWEFEQLLKSCGELLDSLNLGHQALFQDKIIRTLDFSTPGRIAAGVAFLAFLKDKWSEETHLSSGYVLDFLAIQLWRAWIRHKNRMQLLSSVRPLLIQPEEQQTGPEDRARLEPEERAPAAAPERSAWNLGAGLNGHPHRE

SEQ ID NO: 55 - DNA, 6000 bp, Unknown
  Simian adenovirus 42.1
  CDS (3)..(623): 22K
  CDS (1702)..(2016): E3\12.5K
  CDS (4121)..(4930): E3\CR1\gamma
  CDS (5614)..(5997): E3\14.7K
ggatggcacccagaaagaagcagccgccgccgccgccagcatacatgcttctggaggaagaggaggactgggacagtcaggcagaggaggtttcggacgaggacgaggaggaggagatgatggaagactgggaggaggacagcctagacgaggaagcttcagaggccgaagaggtggcagacgcaacaccatcaccctcggccgcagccccctcgccggcgcccccgaaatcctccgaccccagcagcagcgctataacctccgctcctccggcgccggcgcccacccgcagcagacccaaccgtagatgggacactacaggaaccggggtcggtaagtccaagtgccccccagcgccgcccccgcaacaggagcaacagcagcagcagcggcgacagggctaccgctcgtggcgcggacacaagaacgccatagtcgcctgcttgcaagactgcgggggcaacatctccttcgcccgccgcttcctgctcttccaccacggggtggcttttccccgcaatgtcctgcattactaccgtcatctctacagcccctactgcggcggcagcggcgacccagagggagcggcggcagcagcagcgccagccacagcggcgaccacctaggaagacctccgcgggcaagacggcgggagccgggagacccgcggcggcggcggtagcggcggcggcgggcgcactgcgcctctcgcccaacgaacccctctcgacccgggagctcagacacaggatcttccccactctgtatgctatcttccagcagagcagaggccaggaacaggagctgaaaataaaaaacagatctctgcgctccctcacccgcagctgtctgtatcacaaaagcgaagatcagcttcggcgcacgctggaggacgcggaggcactcttcagcaaatactgcgcgctgactcttaaggactagccgcgcgcccttctcgaatttaggcgggagaaagactacgtcatcgccgaccgccgcccagcccacccagccgacatgagcaaagagattcccacgccctacatgtggagctaccagccgcagatgggactcgcggcgggagcggcccaagactactccacccgcatgaactacatgagcgcggggccccacatgatctcacgggttaatgggatccgcgccgagcgaaaccaaatactgctggaacaggcggccataaccgccacaccccgtcatgacctcaatccccgaaattggcccgccgccctcgtgtaccaggaaaccccctctgccaccaccgtggtacttccgcgtgacacccaggccgaagtccagatgactaactcaggggcgcagctcgcgggcggctttcgtcacggggtgcggccgcaccggccgggtatattacacctggcgatcagaggccgaggtattcagctcaacgacgagtcggtgagctcttcgctcggtctccgtccggacggaaccttccagatcgccggatcaggtcgctcctcattcacgcctcgccaggcgtacctgactctgcagacctcctcctcggagcctcgctccggcggcatcggcaccctccagttcgtggaggagttcgtgccctcggtctacttcaaccccttctcgggacctcccggacgctaccccgaccagttcatcccgaactttgacgcggtgaaggactcggcggacggctacgactgaatgtcaagtgctgaggcagagagcgttcgcctgaaacacctcgagcactgccgccgcttcgcctgctttgcccgcagctccggtgagttctgctactttcagctgcccgaggagcataccgaggggccggcgcacggcgtccgcctaaccacccagggcgaggttacctgtacccttatccgggagtttaccctccgtcccctgctagtggagcgggagcggggttcttgtgttataactatcgcctgcaactgccctaaccctggattacatcaagatctttgttgtcacctgtgcgctgagtataataaacgctgagatcagactctactggggctcctgtcgccatcctgtgaacgccaccgtcttcacccaccccgagcagccccaggcgaacctcacctgcggcctgcgtcggagggccaagaagtacctcacctggtacttcaacggcaccccctttgtggtttacaacagcttcgaccaggacggagttgccttgagagacgacctttccggtctcagctactccattcacaagaacaccaccctccacctcttccctccctacctgccgggaacctacgagtgcgtcaccggccgctgcacccacctcctccgcctgatcgtaaaccagacctttccgggaacacacctcttccccagaacaggaggtgagctcaggaaaccccctggggcccagggcggagacttaccttcgacccttgtggggttaggattttttatcgccgggttgctggctctcctgatcaaagcttccttcagatttgttctctccctttacttttatgaacagctcaacttctaataacactaccttttctcaggaatcgggtagtaacttctcttctgaaatcgggctgggtgtgctgcttactctgttgatttttttccttatcatacttagccttctgtgcctcaggctcgccgcctgctgcgcacatatctacatctacagccggttgcttaactgctggggtcgccatccaagatgaacggggctcaggtgctatgtctgctggccctggtggcctgcagtgccgccgtcaattttgaggaacccgcttgcaatgtgactttcaagcctgagggcgcacattgcaccactctggttaaatgtgtgacctctcatgaaaaactgctcatcgcctacaaaaacaaaacaggcgagttcgcggtctatagtgtgtggcaacccggagaccataataactactcagtcaccgtcttcgagggtgcggagtctaagaaattcgattacacctttccctttgaggagatgtgtgatgcggtcatgtacctgtccaaacagtacaagctgtggccccccacccccgaggcgtgtgtggaaaacactgggtctttctgctgtctctctctggcaatcactgtgcttgctctaatctgcacgctgctatacatgagattcaggcagaggcgaatctttatcgatgagaaaaaaatgccttgatcgctaacaccggctttctgtctgcagaatgaaagcaatcacctccctactaatcagcaccaccctccttgcgattgcccatgggttgacacgaatcgaagtgccagtggggtccaatgtcaccatggtgggccccgccggcaattcctccctgatgtgggaaaaatatgtccgtaatcaatgggatcattactgctctaatcgaatctgtatcaagcccagagccatctgcgacgggcaaaatctaactttgattgatgtgcaaatgacggatgctgggtactattacgggcagcggggagaaatgattaattactggcgaccccacaaggactacatgctgcatgtagtcaaggcagtccccactactaccacccccaccactaccactcccactactaccacccccactactaccactagcactgctactaccgctgcccgcaaagctattacccgcaaaagcaccatgcttagcaccaagccccattctcactcccacgccggcgggcccaccggtgcggcctcagaaaccaccgagctttgcttctgccaatgcactaacgccagcgcccacgaactgttcgacctggagaatgaggatgatgaccagctgagctccgcttgcccggtcccgctgcccgcagagccggtcgccctgaagcagatcggtgatccatttattgactctcctgtttatccctctcccgaataccctcccgactctaccttccacatcacgggcaccaacgaccccaacctctccttctacctgatgctgctgctttgtatctctgtggtatcttccgcgctcatgttactgggcatgttctgctgcctcatctgccgcagaaaaagaaagtctcgctctcagggccaaccactgatgcccttcccctaccccccagattttgcagataacaagatatgagcacgctgctgacactaaccgctttactcgcctgcgctctaacccttgtcgcttgcgaatccagataccacaatgtcacagttgtgacaggagaaaatgttacattcaactccacggccgacacccagtggtcgtggagcggccacggtagctatgtatacatctgcaatagctccacctcccctagcatgtcctctcccaagtaccactgcaatgccagtctgttcaccctcatcaacgcctccacctcggacaatggactctatgtaggctatgtgacacccggtgggcagggaaagacccacgcctacaacctgcaagttcgccacccctccaccaccgccaccacctctgccgcccctacccgcagcagcagcagcagcagcagcagcagcagattcctgactttaatcctagccagctcaacaaccaccgccaccgctgacaccacccacagctccgcgcccgaaaccacccacacccaccacccagagacgaccgcggcctccagcgaccagatgtcggccaacatcaccgcctcggatcttgaacttgcttcaacccccaccccaaaaccagtggatgcagccgacgtctccgccctcgtcaatgactgggcggggctgggaatgtggtggttcgccataggcatgatggcgctctgcctgcttctgctctggctcatctgctgcctcaaccgcaggcgggccagacccatctatagacccatcattgttctcaaccccgctgatgatgggatccatagattggatggtctgaaaaacctacttttctcttttacagtatgataaattgagacatgcctcgcattttcatgtacttgacacttctcccactttttctggggtgttctacgctggccgccgtctctcacctcgaggtagactgcctcacacccttcactgtctacctgatttacggattggtcaccctcactctcatctgcagcctaatcacagtagtcatcgccttcatccagtgcattgactacatctgtgtgcgcctcgcatacctgagacaccacccgcagtaccgagacagaaacattgcccaactcctaagactgctctaatcatgcataagactgtgatctgcctcctcatcctcctctccctgcccgctctcgtctcatgccagcccaccacaaaacctccacgaaaaagacatgcctcctgtcgcttgagccaactgtggaatattcccaaatgctacaatgaaaagagcgagctttccgaagcctggctatatgcggtcatgtgtgtccttgtcttctgcagcacaatctttgccctcatgatctacccccactttgatttgggatggaatgcggtcgatgccatgaattaccctacctttcccgcgcccgatatgattccactccgacaggttgtggtgcccgtcgccctcaatcaacgccccccatcccctacacccactgaggtcagctactttaatctaacaggcggagatgactgacactctagatctagaaatggacggcatcggcaccgagcagcgtctcctacagaggcgcaagcaggcggctgaacaagagcgcctcaatcaggagctccgagatctcattaacctgcaccagtgcaaaaaaggcatcttttgcctggtcaagcaggccgatgtcacctacgagaaaaccggtaacagccaccgcctcagctacaagctgcccacccaacgccagaagttggtgctcatggtgggtcagaatcccatcaccgtcacccagcactcggtggagaccgaggggtgtctgcactccccctgtcagggtccggaagacctctgcaccctggtaaagaccctgtgtggtcttagagatttaatcccctttaactaa

SEQ ID NO: 56 - protein, 207 aa, Unknown
  Synthetic Construct
MAPRKKQPPPPPAYMLLEEEEDWDSQAEEVSDEDEEEEMMEDWEEDSLDEEASEAEEVADATPSPSAAAPSPAPPKSSDPSSSAITSAPPAPAPTRSRPNRRWDTTGTGVGKSKCPPAPPPQQEQQQQQRRQGYRSWRGHKNAIVACLQDCGGNISFARRFLLFHHGVAFPRNVLHYYRHLYSPYCGGSGDPEGAAAAAAPATAATT

SEQ ID NO: 57 - protein, 105 aa, Unknown
  Synthetic Construct
MSSAEAESVRLKHLEHCRRFACFARSSGEFCYFQLPEEHTEGPAHGVRLTTQGEVTCTLIREFTLRPLLVERERGSCVITIACNCPNPGLHQDLCCHLCAEYNKR

SEQ ID NO: 58 - protein, 270 aa, Unknown
  Synthetic Construct
MSTLLTLTALLACALTLVACESRYHNVTVVTGENVTFNSTADTQWSWSGHGSYVYICNSSTSPSMSSPKYHCNASLFTLINASTSDNGLYVGYVTPGGQGKTHAYNLQVRHPSTTATTSAAPTRSSSSSSSSSRFLTLILASSTTTATADTTHSSAPETTHTHHPETTAASSDQMSANITASDLELASTPTPKPVDAADVSALVNDWAGLGMWWFAIGMMALCLLLLWLICCLNRRRARPIYRPIIVLNPADDGIHRLDGLKNLLFSFTV

SEQ ID NO: 59 - protein, 128 aa, Unknown
  Synthetic Construct
MTDTLDLEMDGIGTEQRLLQRRKQAAEQERLNQELRDLINLHQCKKGIFCLVKQADVTYEKTGNSHRLSYKLPTQRQKLVLMVGQNPITVTQHSVETEGCLHSPCQGPEDLCTLVKTLCGLRDLIPFN

SEQ ID NO: 60 - DNA, 960 bp, Unknown
  Simian adenovirus 42.1
  CDS (6)..(546): E1a
  CDS (657)..(952): E1a
gaaaaatgagacatttcacctacgatggcggtgtgctcaccggccagctggctgcctcggtcctggacgccctgatcgaggaggtattggccgacaattatcctcctccagctcattttgagccacctactcttcacgaactgtatgatttggacgtggtggcacctagcgacccgaacgagcaggcggtttccagtttttttcctgactctatgctgttggccagccaggagggggtcgagctcgagacccctcctccaatcgccgtttctcctgagcctccgaccctgaccaggcagcccgatcgccgtgttggacctgcgactatgccccatctgctgcccgaggtgatcgatctcacctgtaacgagtctggttttccacccagcgaggatgaggacgaagagggtgagcagtttgtgttagattctgtggaggaacccgggcgcggttgcagatcttgtcaataccatcggaaaaatacaggagacccccaaattatgtgttccctgtgttatatgaagacgacctgtatgtttatttacagtaagtttgtgattggtgggtcggtgggctgtagtgtgggtaggtggtctgtggttttttttttttaatatcagcttgggctaaaaaaactgctatggtaattttttaaggtccggtgtctgaacctgagcaggaagctgaaccggagcctgagagtcgccccaggagaaggcctgcaattctaactagaccgagtgcacctgtagcgagggacctcagcagtgcagagaccaccgattccggtccttcctcatcccctccagagattcatcccgtggtgcctttgtgtcccctcaagcccgttgccgtgagagttagtgggcggagggccgccgtggagagcattgaggacttgcttaatgagacacaggaacctttggacttgagctgtaaacgccctaggcaataaacctg

SEQ ID NO: 61 - protein, 279 aa, Unknown
  Synthetic Construct
MRHFTYDGGVLTGQLAASVLDALIEEVLADNYPPPAHFEPPTLHELYDLDVVAPSDPNEQAVSSFFPDSMLLASQEGVELETPPPIAVSPEPPTLTRQPDRRVGPATMPHLLPEVIDLTCNESGFPPSEDEDEEGEQFVLDSVEEPGRGCRSCQYHRKNTGDPQIMCSLCYMKTTCMFIYSPVSEPEQEAEPEPESRPRRRPAILTRPSAPVARDLSSAETTDSGPSSSPPEIHPVVPLCPLKPVAVRVSGRRAAVESIEDLLNETQEPLDLSCKRPRQ

SEQ ID NO: 62 - DNA, 940 bp, Unknown
  Simian adenovirus 42.1
  CDS (3)..(343): 33K
  CDS (663)..(939): 33K
ggatggcacccagaaagaagcagccgccgccgccgccagcatacatgcttctggaggaagaggaggactgggacagtcaggcagaggaggtttcggacgaggacgaggaggaggagatgatggaagactgggaggaggacagcctagacgaggaagcttcagaggccgaagaggtggcagacgcaacaccatcaccctcggccgcagccccctcgccggcgcccccgaaatcctccgaccccagcagcagcgctataacctccgctcctccggcgccggcgcccacccgcagcagacccaaccgtagatgggacactacaggaaccggggtcggtaagtccaagtgccccccagcgccgcccccgcaacaggagcaacagcagcagcagcggcgacagggctaccgctcgtggcgcggacacaagaacgccatagtcgcctgcttgcaagactgcgggggcaacatctccttcgcccgccgcttcctgctcttccaccacggggtggcttttccccgcaatgtcctgcattactaccgtcatctctacagcccctactgcggcggcagcggcgacccagagggagcggcggcagcagcagcgccagccacagcggcgaccacctaggaagacctccgcgggcaagacggcgggagccgggagacccgcggcggcggcggtagcggcggcggcgggcgcactgcgcctctcgcccaacgaacccctctcgacccgggagctcagacacaggatcttccccactctgtatgctatcttccagcagagcagaggccaggaacaggagctgaaaataaaaaacagatctctgcgctccctcacccgcagctgtctgtatcacaaaagcgaagatcagcttcggcgcacgctggaggacgcggaggcactcttcagcaaatactgcgcgctgactcttaaggact

SEQ ID NO: 63 - protein, 206 aa, Unknown
  Synthetic Construct
MAPRKKQPPPPPAYMLLEEEEDWDSQAEEVSDEDEEEEMMEDWEEDSLDEEASEAEEVADATPSPSAAAPSPAPPKSSDPSSSAITSAPPAPAPTRSRPNRRWDTTGTGVGKSKPAAAAVAAAAGALRLSPNEPLSTRELRHRIFPTLYAIFQQSRGQEQELKIKNRSLRSLTRSCLYHKSEDQLRRTLEDAEALFSKYCALTLKD

SEQ ID NO: 64 - DNA, 37820 bp, Unknown
  Simian adenovirus 42.2
  repeat_region (1)..(119): ITR
  CDS (1609)..(2259): E1b\19K
  CDS (3624)..(4064): pIX
  misc_feature (4129)..(5753): IVa2   complement (4129..5462,5741..5753)
  misc_feature (5235)..(14243): pol   complement (5235..8837,14235..14243)
  misc_feature (8639)..(14243): pTP   complement (8639..10642,14235..14243)
  CDS (11117)..(12376): 52K
  CDS (12403)..(14172): pIIIa
  CDS (14285)..(16042): penton
  CDS (16048)..(16644): pVII
  CDS (16743)..(17843): V
  CDS (17872)..(18111): pX
  CDS (18219)..(18995): pVI
  CDS (19126)..(21996): hexon
  CDS (22029)..(22661): protease
  misc_feature (22792)..(24423): DBP  complement
  CDS (24461)..(26950): 100K
  CDS (27670)..(28350): pVIII
  CDS (28354)..(28668): E3\12.5K
  CDS (29366)..(29842): E3\gp19K
  CDS (29874)..(30782): E3\CR1\beta
  CDS (31603)..(31872): E3\RID\alpha
  CDS (31878)..(32276): E3\RID\beta
  CDS (32810)..(34594): fiber
  misc_feature (34782)..(35939): E4\orf\6/7   complement (34782..35054,35757..35939)
  misc_feature (35058)..(35939): E4\orf6   complement
  misc_feature (35842)..(36207): E4\orf4   complement
  misc_feature (36217)..(36561): E4\orf3   complement
  misc_feature (36561)..(36950): E4\orf2   complement
  misc_feature (37011)..(37394): E4\orf1   complement
  repeat_region (37702)..(37820): ITR    complement
catcatcaataatataccttattttggattgaagccaatatgataatgaggtgggcggagcggggcggagttgggaggcgcggggcggggcggcggcgcggggcgggccgggaggtgtggcggaagttgagtttgtaagtgtggcggatgagacttgctagcgccggatgtggtaaaagtgacgtttttggagtgcgacaacgcccacgggaagtgacatttttcccgcggtttttaccggatgtcgtagtgaatttgggcgttaccaagtaagatttggccattttcgcgggaaaactgaaatggggaagtgaaatctgattaatttcgcgttagtcataccgcgtaatatttgccgagggccgagggactttgaccgattacgtggaggaatcgcccaggtgttttttgaggtgaatttccgcgttccgggtcaaagtctccgttttattattatagtcagctgacgcggagtgtatttatacccgctgatctcgtcaagaggccactcttgagtgccagcgagtagagttttctcctctgccgcttcgctccgctccgacaccgggggaaaaatgagacatttcacctacgatggcggtctgctcaccggccagctggctgcctcggtcctggacgccctgatcgaggaggtattggccgacaattatcctcctccagctcattttgagccgcctactcttcacgaactgtatgatttggacgtggtggcacctagcgacccgaacgagcaggcggtttccagtttttttcctgactctatgctgttggccagccaggagggggtcgagctggagacccctcctccaattctcgtttcccctgagccgccgaccctgaccaggcagcccgatcgccgtgttggacctgcgactatgccccatctgctgcccgaggtgatcgatctcacctgtaacgagtctggttttccacccagcgaggatgaggacgaagagggtgagcagtttgtgttagattctgtggaggaacccgggcgcggttgcagatcttgtcaataccatcggaaaaatacaggagacccccaaattatgtgttccctgtgttatatgaagacgacctgtatgtttatttacagtaagtttgtgattggtgggtcggtgggctgtagtgtgggtaggtggtctgtggtttttttttttttaatatcagcttgggctaaaaaactgctatggtaatttttttaaaggtccggtgtctgaacctgagcaggaagctgaaccggagcctgagagtcgccccaggagaaggcctgcaattctaactagaccgagtgcacctgtagcgagggacctcagcagtgcagagaccaccgattccggtccttcctcatcccctccagagattcaccccgtggtgcctttgtgtcccctcaagcccgttgccgtgagagttagtgggcggagggccgccgtggagagcattgaggacttgcttaatgagacacaggaacctttggacttgagctgtaaacgccctaggcaataaacctgcttacctggactgaatgagttgacgcctatgtttgcttttgaatgacttaatgtgtatataataaagagtgagataatgtttaattgcatggtgtgtttgattggggcggggtttgttgggtatataagcttccctgggctaaacttggttacacttgacctcatggaggcctgggagtgtttagagagctttgccgaagtgcgtgctttgctggaagagagctctaataatacctctgggtggtggaggtatttttggggctctccccaggctaagttagtttgtagaatcaaggaggattacaagtgggaatttgaacagcttttgaaatcctgtggtgagctcttggattctttgaatctgggccaccaggctcttttccaggacaagatcatcaggactttggatttttccacaccggggcgcattgctgccggggttgcttttctagcttttttgaaggataaatggagcgaagagacccacttgagttcgggatacgtcctggattttctggccatacaactgtggagagcatggatcaggcacaagaacagaatgcaactgttgtcttccgtccgtccgttgctgattcagccggaggagcagcagaccgggccggaggaccgggctcgtccggaaccagaggagagggcgcccgcggcggcgccggagaggagcgcgtggaacctgggagccggcctgaacggccatccacatcgggagtgaatgttggacaggtggcggatctctttccagaactgcgacgaatcttgactattagggaggatggacaatttgttaagggccttaagagggagcggggggcttctgaacataacgaggaggccagtaatttagcttttagtctgatgaccagacaccgtcccgagtgcattacttttcagcagattaaagataattgtgccaatgagttagatctgctgggtcagaagtacagcatagagcagttgaccacttactggttgcagccgggtgatgatctggaggaagctattagggtgtatgccaaggtggccctgaggcccgattgcaagtacaagctcaaggggctggtgaatatcaggaattgttgctacgtttctgggaacggggcggaggtggagatagagaccgatgacagggtggcctttaggtgcagcatgatgaatatgtggcctggggtgctgggcatggacggggtggtgattatgaatgtgaggttcacggggcccaattttaatggcacggtgttcctgggcaacaccaacttggtgctgcacggggtgagcttctatggctttaacaacacctgtgtggaggcctggaccgatgtgaaggtccgtggctgtgccttctacggatgttggaaggcggtagtgtgtcgccccaagagcaggagttccattaaaaaatgcttgtttgagaggtgcaccctgggggtgctggcggagggcaactgtcgggtgcgccacaatgtggcctccgaatgcggttgcttcatgctagtcaagagcgtggcggttatcaagcataacatggtgtgcggcaacagcgaggacaaggcctcgcagatgctgacctgctcggatggcaactgccacttactgaagaccgtacatataaccagccacagccgcaaggcctggcccgtgttcgagcacaacgtgttgacccgctgctctttgcatctgggcaacaggaggggtgtgttcctgccctatcaatgcaacttgagccacaccaaggtcttgctagagcccgaaagcatgtccaaggtgaacctgaacggggtgtttgacatgaccctgaagatatggaaggtgctgaggtacgacgagaccaggtctcggtgcaggccctgcgagtgcgggggcaagcatatgaggaaccagcctgtgatgctggatgtgaccgaggagctgaggcctgaccacttggttctggcctgcaccagggccgagtttggttctagcgatgaagacacagactgaggtgggtgagtgggcgtggtctgggggtgggaaacaatatataagttgggggtcttagggtctctgtgtctgttttgcagagggaccgccggcgccatgagcgggagcagtagcagcaacgccttggatggcagcatcgtgagcccttatttgacgacgcgcatgccccactgggccggggtgcgtcagaatgtgatgggctccagcatcgacggacgacccgtgctgcccgcaaattccgccacgctgacctacgcgaccgtcgcggggaccccgttggacgccaccgccgccgccgccgccaccgccgccgcctcggccgtgcgcagcctggccacggactttgcattcttgggacccttggccaccggggcggccgcccgtgccgccgttcgcgatgacaagctgaccgccctgctggcgcagttggatgcgcttacccgggaactgggtgacctttcgcagcaggtcgtggccctgcgccagcaggtctccgccctgcaggctagcgggaatgcttctcctgcaaatgccgtttaagataaataaaaccagactctgtttggattaaagaaaagtagcaagtgcattgctctctttatttcataattttccgcgcgcgataggcccgagtccagcgttctcggtcgttgagggtgcggtgtatcttctccaggacgtggtagaggtggctctggacgttgagatacatgggcatgagcccgtcccgggggtggaggtagcaccactgcagagcttcatgctccggggtggtgttgtagatgatccagtcgtagcaggagcgctgggcatggtgcctaaaaatgtccttaagcagcaggccgatggccagggggaggcccttggtgtaagtgtttacaaaacggttgagttgggaagggtgcatgcggggtgagatgatgtgcatcttagattgtatttttagattggcgatgtttcctcccagatcccttctgggattcatgttgtggaggaccaccagcacagtatatccggtgcacttgggaaatttgtcatgcagcttagagggaaatgcgtggaagaacttggagacgcccttgtggcctcccagattctccatgcattcgtccatgatgatggcaatgggcccgcgggaggcggcctgggcaaagatgtttctggggtcactgacatcgtagttgtgttccagggtgagatcgtcataggccatttttataaagcgcgggcggagggtgcccgactgggggatgatggttccctcgggccccggggcgtagttgccttcgcagatctgcatttcccaggccttaatttctgaggggggaatcatgtccacttgcggggcgatgaagaaaacggtttccggagccggggagattaactgggatgagagcaggtttctcagcagctgtgactttccacagccggtggggccataaataacacctataaccggctgcagctggtagttgagcgagctgcagctgccgtcgtcccggaggaggggggccacctcattgagcatgtcccggacgcgcttgttctcctcgaccaggtccgccagaaggcgctcgccgcccagggacagcagctcttgcaaggaagcaaagtttttcagcggcttgaggccgtccgccgtgggcatgtttttcagggtctgaccgagcagctccaggcggtcccagagctcggtgacgtgctctacggcatctctatccagcatatctcctcgtttcgcgggttggggcggctttcgctgtagggcaccaggcgatggtcgtccagcgcggccagagtcatgtccttccatgggcgcagggtcctcgtcagggtggtctgggtcacggtgaaggggtgcgccccgggctgggcgctggccagggtgcgcttgagactggtcctgctggtgctgaagcgctgccggtcttcgccctgcgcgtcggccaggtagcatttgaccatggtgtcgtagtccagcccctccgcggcgtgtcccttggcgcgcagcttgcccttggaggtggcgccgcacgcggggcactgcaggctcttgagcgcgtagagcttgggggcgaggaagaccgattcgggggagtaggcgtccgcgccgcaggccccgcacacggtctcgcactccaccagccaggtgagctcggggcgctcggggtcaaaaaccaggtttcccccatgctttttgatgcgtttcttacctcgggtctccatgaggcggtgtccccgctcggtgacgaagaggctgtccgtgtctccgtagaccgacttgaggggtctgtcctccaggggggtccctcggtcctcttcgtagagaaactcggaccactctgagacgaaggcccgcgtccaggccaggacgaaggaggctaggtgggaggggtaccggtcgttgtccactagggggtccactttttccaaggtgtgaagacacatgtcgccctcctcggcgtccaggaaggtgattggcttgtaggtgtaggccacgtgacccggggttccggacgggggggtataaaagggggtgggggcgcgctcgtcctcactctcttccgcatcgctgtctgcgagggccagctgctggggtgagtattccctctcgaaggcgggcatgacctcagcgctgaggctgtcagtttctaaaaacgaggaggatttgatgttcacctgtcccgagctgatgcctttgagggtgcctgcgtccatctggtcagaaaacacgatctttttattgtccagcttggtggcgaacgacccgtagagggcgttggagagcagcttggcgatggagcgcagggtctgatttttgtccctgtcggcgcgctccttggccgcgatgttgagctgcacgtactcgcgcgcgacgcagcgccactcggggaagacggtggtgcgctcgtcgggcaccaggcgcacgcgccagccgcggttgtgcagggtgacgaggtccacgctggttgcgacctcgccgcgcaggcgctcgttggtccagcagaggcgcccgcccttgcgcgagcagaaggggggcagggggtcgagttgggtttcgtccggggggtccgcgtccaccgtgaagaccccggggcgcaggcgcgcgtcgaagtagtcgatcttgcatccttgcaagtccagcgcctgctgccagtcgcgggcggcgagcgcgcgctcgtaggggttgagcggcgggccccagggcatggggtgggtgagcgcggaggcgtacatgccgcagatgtcgtagacgtagaggggctcccggaggatgcccaggtaggtggggtagcagcggccgccgcggatgctggcgcgcacgtagtcgtagagctcgtgcgagggggcgaggaggtcggggcccaggttggtgcgggcggggcgctccgcgcggaagacgatctgcctgaagatggcatgcgagttggaagagatggtggggcgctggaagacgttgaagctggcgtcctgcaggccgacggcgtcgcgcacgaaggaggcgtaggactcgcgcagcttgtgcaccagctcggcggtgacctgcacgtcgagcgcgcagtagtcgagggtctcgcggatgatgtcatacttagcctgccccttctttttccacagctcgcggttgaggacgaactcttcgcggtctttccagtactcttggatcgggaaaccgtccggctccgaacggtaagagcccagcatgtagaactggttgacggcctggtaggcgcagcagcccttctccacggggagggcgtaggcctgcgcggccttgcggagcgaggtgtgggtcagggcgaaggtgtccctgaccatgaccttgaggtactggtgtttgaagtcggagtcgtcgcagccgccccgctcccagagcgagaagtcggtgcgctttttggagcgggggttgggcagcgcgaaggtgacatcgttgtagaggatcttgcccgcgcgaggcatgaagttgcgggtgatgcggaagggccccggcacttccgagcggttgttgatgacctgggcggcgagcacgatctcgtcgaagccgttgatgttgtggcccacgatgtagagttccaggaagcggggccggcccttgacgctgggcagcttctttagctcttcgtaggtgagctcctcgggcgaggcgaggccgtgctcggccagggcccagtccgccagatgcgggttgtccgcgaggaaggaccgccagaggtcgcgggccaggagggtttgcaggcggtccctgaaagtcctgaactggcggcccacggccatcttttcgggggtgacgcagtagaaggtgagggggtcttgctgccaggagtcccagtcgagctccagggcgaggtcgcgcgcggcggcgaccaggcgctcgtcgcccccgaatttcatgaccagcatgaagggcacgagctgctttccgaaggcgcccatccaagtgtaggtctctacatcgtaggtgacaaagagacgctccgtgcgaggatgcgagccgatcgggaagaactggatctcccgccaccagttggaggagtggctgttgatgtggtggaagtagaagtcccgtcggcgggccgagcactcgtgctggcttttgtaaaagcgagcgcagtactggcagcgctgcacgggctgtacctcttgcacgagatgcacctgccgaccgcggacgaggaagctgagtgggaatctgagccccccgcatggctcgcggcctggctggtgctcttctactttggatgcgtggccgtcaccgtctggctcctcgaggggtgttacggtggagcggaccaccacgccgcgcgagccgcaggtccagatatcggcgcgcggcggtcggagtttgatgacgacatcgcgcagctgggagctgtccatggtctggagctcccgcggcggcggcaggtcagccgggagttcttgcaggtttacctcgcagagacgggccagggcgcggggcaggtccaggtggtacttgaactcgagaggggtgttggtggcggcgtcgatggcttgcaggaggccgcagccccggggcgcgacgacggtgccccgcggggcggtgaagctgccgccgccgctcctgctgtcgccgccggtggcagggcttagaagcggtgccgcggtcgggcccccggaggtagggggggctccggtcccgcgggcaggggcggcagcggcacgtcggcgccgcgcgcgggcaggagctggtgctgcgcccggaggttgctggcgaaggcgacgacgcggcggttgatctcctggatctggcgcctctgcgtgaagacgacgggtccggtgagcttgaacctgaaagagagttcgacagaatcaatctcggtgtcattgaccgcgacctggcgcaggatctcctgcacgtcgcccgagttgtcttggtaggcgatctctgccatgaactgttcgatctcttcctcctggaggtctccgcgtccggcgcgctccacggtggccgccaggtcgttggagatgcgcgccatgagctgcgagaaggcgttgagtccgccctcgttccagacccggctgtagaccacgccgccctggtcgtcgcgggcgcgcatgaccacctgcgcgaggttgagttccacgtggcgcgcaaagacggcgtagttgcgcaggcgctggaagaggtagttgagggtggtggcggtgtgctcggccacgaagaagtacatgacccagcggcgcaacgtggattcgttgatgtcccccaaggcctccagtcgctccatggcctcgtagaagtccacggcgaagttgaaaaactgggagttgcgcgccgacacggtcaactcctcctccagaagacggatgagctcggcgacggtgtcgcgcacctcgcgctcgaaggctatggggatctcttcctccgccagcatcaccacctcttcctcttcctcttcctctggcacttccatgatggcttcttcttcctcctcttcggggggcggcggcggcggtgggggagggggcgctcggcgccggcggcggcgcaccgggaggcggtccacgaagcgctcgatcatctccccgcggcggcgacgcatggtctcggtgacggcgcggccgttctctcgggggcgcagctggaagacgccgccggtcatctggtgctggggcgggtggccgtggggcagcgagaccgcgctgacgatgcatctcaacaattgctgcgtaggtacgccgccgagggacctgagggagtccagatccaccggatccgaaaacctttcgaggaaggcatctaaccagtcgcagtcgcaaggtaggctgagcaccgtggcgggcggcggggggtggggggagtgtctggcggaggtgctgctgatgatgtaattgaagtaggcggtcttgacacggcggatggtcgacaggagcaccatatccttgggcccggcctgctggatgcggaggcggtcggccatgccccaggcttcgttctggcatctgcgcaggtctttgtagtagtcttgcatgagcctttccaccggcacctcttctccttcttcttctgacatctctgctgcatctgcggccctggggcggcggcgtgcgcccctgccccccatgcgcgtcaccccgaaccccctgagcggctggagcagggccaggtcggcgacgacgcgctcggccaggatggcctgctggacctgcgtgagggtggtttggaagtcatccaagtccacgaagcggtggtaggcgcccgtgttgatggtgtaggtgcagttggccatgacggaccagttgacggtctggtggcccggttgcgtcatctcggtgtacctgaggcgcgagtaggcgcgcgagtcgaagatgtagtcgttgcaagtccgcaccaggtactggtagcccaccaggaaatgcggcggcggctggcggtagaggggccagcgcagggtggcgggggctccgggggccaggtcttccagcatgaggcggtggtattcgtagatgtacctggacatccaggtgatgcccgcggcggtggtggaggcgcgcgggaagtcgcgcacccggttccagatgttgcgcagcggcagaaagtgctccatggtaggcgtgctctggccggtcaggcgcgcgcagtcgttgatactctagaccggggaaaacgaaagccggtcagcgggcactcttccgtggtctggtggataaattcgcaagggtatcatggcggagggcctcggttcgagccccgggcccgggccggacggtccgccatgatccacgcggttaccgcccgcgtgtcgaacccaggtggcgacgtcagacaacggtggagtgttccttttgggttttttccaaatttttttggccgggtgccgacgccgccgcgtaagagactagagtgcaaaagcgaaagcagtaagtggctcgctccctgtagcccggaggatccttgctaagggttgcgttgcggcgaaccccggttcgagtctggctctcgcgggccgctcgggccggccggaaccgcggctaaggcgggattggcctccccctcattaaagaccccgcttgcggattcctccggacacaggggacgagcccctttttacttttgcttttctcagatgcatccggtgctgcggcagatgcgccccccgccccagcagcagcagcagcaacatcagcaagagcgtcaccagcagcagcgggagtcatgcagggccccctcgcccacgctcggcggtccggcgacctcggcgtccgcggccgtgtctggagccggcggcggggggctggcggacgacccggaggagcccccgcggcgcagggccagacagtacctggacctggaggagggcgagggcctggcgcggctgggggcgccgtcccccgagcgccacccgcgggtgcagctgaagcgcgactcgcgcgaggcgtacgtgcctcggcagaacctgttcagggaccgcgcgggcgaggagcccgaggagatgcgggaccgcaggttcgccgcggggcgggagttgcggcaggggctgaaccgggagcggctgctgcgcgaggaggactttgagcccgacgcgcggacggggatcagccccgcgcgcgcgcacgtggcggccgccgacctggtgacggcgtacgagcagacggtgaaccaggagatcaacttccaaaaaagcttcaacaaccacgtgcgcacgctggtggcgcgcgaggaggtgaccatcggcctgatgcacctgtgggactttgtgtgcgcgctggagcagaaccccaacagcaagcctctgacggcgcagctgttcctgatagtgcagcacagcagggacaacgaggcgttcagggacgcgctgctgaacatcaccgagcccgagggtcggtggctcctggacctgattaacatcttgcagagcatagtggtgcaggagcgcagcctgagcctggccgacaaggtggcggccatcaattactcgatgctcagtctgggcaagttttacgcgcgcaagatctaccagacgccgtacgtgcccatagacaaggaggtgaaaatcgacggcttctacatgcgcatggcgctgaaggtgctgaccctgagcgacgacctgggcgtgtaccgcaacgagcgcatccacaaggccgtgagcgtgagccggcggcgcgagctgagcgaccgcgagctgatgcacagcctgcagcgggcgctggcgggggccggcagcggcgacagggaggccgagtcctacttcgaggcgggggcggacctgcgctgggtgcccagccggagggccctggaggccgcgggggcccgccgcgaggactatgcagacgaggaggaggaggatgacgaggagtacgagctagaggagggcgagtacctggactaaaccgcaggtggtgtttttggtagatgcaagacccgaacgtggtggacccggcgctgcgggcggctctgcagagccagccgtccggccttaactctacagacgactggcgacaggtcatggaccgcatcatgtcgctgacggcgcgcaatccggacgcgttccggcagcagccgcaggccaacaggctctccgccatcttggaggcggtggtgcctgcgcgcgcgaaccccacgcacgagaaggtgctggccatagtaaacgcgctggccgagaacagggccatccgcccggacgaggccgggctggtgtacgacgcgctgctgcagcgcgtggcccgctacaacagcggcaacgtgcagaccaacctggaccggctggtgggggacgtgcgcgaggcggtggcgcagcgggagcgcgcggagcggcagggcaacctcggctccatggtggcgctgaacgccttcctgagcacgcagccggccaacgtgccgcgggggcaggaggactacaccaactttgtaagcgcgctgcggctgatggtgaccgagaccccccagagcgaggtgtaccagtcggggccggactacttcttccagaccagcagacagggcctgcagacggtgaacctgagccaggctttcaagaacctgcgggggctgtggggcgtgaaggcgcccaccggggaccgggcgacggtgtccagcctgctgacgcccaactcgcgcctgctgctgctgctgatcgcgccgttcacggacagcggcagcgtgtcccgggagacctacctcgggcacctgctgaccctgtaccgcgaggccatcgggcagacccaggtggacgagcacaccttccaggagatcaccagcgtgagccgcgcgctggggcaggaggacacgggcagcctggaggcgaccctgaactacctgctgaccaaccggcggcagaagatcccctcgctgcatagtttgaccaccgaggaggagcgcatcctgcgctacgtgcagcagagcgtgagcctgaacctgatgcgcgacggggtgacgcccagcgtggcgctggacatgaccgcgcgcaacatggaaccgggcatgtacgccgcgcaccggccttacatcaaccgcctgatggactacttgcatcgcgcggcggccgtgaaccccgagtacttcaccaacgccatcctaaacccgcactggctcccgccgcccgggttctacagcggggggttcgaggtccccgaggccaacgacggcttcctgtgggacgacatggacgacagcgtgttctccccgcggccgcaggcgctggcggaggcgtcgctgctccgcctccccaagaaggaagagagccgccggcccagcagcgcggcggcctctctgtccgagctgggggcggcggccgcgcggcccgggtccctggggggcagcccctttcccagcctggtggggtctctgcagagcgggcgcaccacccggccccggctgctgggcgaggacgagtacctgaacaactccctgatgcagccggtgcgggagaaaaacctgccccccgccttccccaacaacgggatagagagcctggtagacaagatgagcagatggaagacctatgcgcaggagcacagggactcgcccgtgctccgtccgcccacgcggcgccagcgccacgaccggcagcgggggctggtgtgggatgacgaggactccgcggacgatagcagcgtgctggacctgggggggagcggcggcaacccgttcgcgcacctgcgcccccgcctggggaggatgtttcaataaaaaaaaaaaaaaatcaagcatgatgcaaggttttttaagcggataaataaaaaactcaccaaggccatggcgaccgagcgttgttggtttcttgttgtgttcccttagtatgcggcgcgcggcgatgtaccacgagggacctcctccctcttatgagagcgtggtgggcgcggcggcggcctctccctttgcgtcgcagctggagccgccgtacgtgcctccgcggtacctgcggcctacggggggaagaaacagcatccgttactcggagctggcgcccctgtacgacaccacccgggtgtacctggtggacaacaagtcggcggacgtggcctccctgaactaccagaacgaccacagcaattttttgaccacggtcatccagaacaatgactacaccccgagcgaggccagcacccagaccatcaatctggatgaccggtcgcactggggcggcgacctgaaaaccatcctgcacaccaacatgcccaacgtgaacgagttcatgttcaccaataagttcaaggcgcgggtgatggtgtcgcgctcgcacaccaaggacgaccgggtggagctgaagtacgagtgggtagagttcgagctgcccgagggcaactactcggagaccatgaccatagacctgatgaacaacgcgatcgtggagcactatctgaaagtgggcaggcaaaacggggtcctggagagcgacatcggggtcaagttcgacaccaggaacttccgcctggggctggacccggtcaccgggctggtcatgcccggggtctacaccaacgaggccttccaccccgacatcatcctgctgcccggctgcggggtggacttcacctacagccgcctgagcaacctgctgggcatccgcaagcggcagcccttccaggagggcttcaggatcacctacgaggacctggaggggggcaacatccccgcgctcctggatgtggaggcctaccaggatagcttgaaggaagaagaggcgggagagggcagcggcggcggcggcggcgccggtcaggaggagggcggggcctcctctgaggcctctgcggacgcagccgccgccgatactgcggccgaggcggaggcggccgaccccgcgatggtggtagaggaagagaaggatatgaatgacgaggcggtgcgcggcgacacctttgtcacccggggggaggagaagaaagcggaggccgaggccgcggcagaggaggcggcagcagcggcggcggcagtagaggcggcggccgaggcggagaagccccccaaggagcccgtgattaagcccctgaccgaagatagcaagaagcgcagttacaacgtgctcaaggacagcaccaacaccgagtaccgcagctggtacctggcctacaactacggcgacccggcgacgggggtgcgctcctggaccctgctgtgtacgccggacgtgacctgcggctcggagcaggtgtactggtcgctgcccgacatgatgcaagaccccgtgaccttccgctccacgcggcaggtcagcaacttcccggtggtgggcgccgagctgctgcccgtgcactccaagagcttctacaacgaccaggccgtctactcccagctcatccgccagttcacctctctgacccacgtgttcaatcgctttcctgagaaccagattctggcgcgcccgcccgcccccaccatcaccaccgtcagtgaaaacgttcctgctctcacagatcacgggacgctaccgctgcgcaacagcatcggaggagtccagcgagtgaccgtaactgacgccagacgccgcacctgcccctacgtttacaaggccctgggcatagtctcgccgcgcgtcctttccagccgcactttttaagcatgtccatcctcatctcgcccagcaataacaccggctggggcctgctgcgcgcgcccagcaagatgttcggaggggcgaggaagcgctccgaccagcaccccgtgcgcgtgcgcgggcactaccgcgctccctggggcgcgcacaaacgcgggcgcaccggcaccgcggggcgcaccaccgtggacgaagccatcgactcggtggtggagcaggcgcgcaactacacgcccgcggtctccaccgtggacgcggctatcgagagcgtggtgcgaggcgcgcggcggtacgccaaggcgaagagccgccggaggcgcgtggcccgccgccaccgccgccgacccgggagcgccgccaagcgcgccgccgccgccttgctccgtcgggccagacgcacgggccgccgcgccgccatgagggccgcgcgccgcctggccgccggtatcaccaccgtggccccccgcgccagaagacgcgcggccgccgccgccgccgcggccatcagcgacctggccaccaggcgccggggcaacgtgtactgggtgcgcgactcggtgagcggcacgcgcgtgcccgtgcgcttccgccccccgcggacttgagaggagaggacaggaaaaagcatcaacatcaacaacaccaccactgagtctcctgctgttgtgtgtatcccagcggcgcgcgcgcacacggcgacatgtccaagcgcaaaatcaaagaagagatgctccaggtcgtcgcgccggagatctatgggcccccgaagaaggaagagcaggatttcaagccccgcaagataaagcgggtcaaaaagaaaaagaaagatgacgatgatggcgaggtggagtttctgcgcgccacggcgcccaggcgcccgctgcagtggaagggtcggcgcgtaaagcgcgttctgcgccccggcaccgcggtggtcttcacgcccggcgagcgctccacccgcactttcaagcgcgtctatgacgaggtgtacggcgacgaagacctgctggagcaggccaacgatcgctccggagagtttgcttacgggaagcggcaccgggcgatggagaaggacgaggtgctggcgctgccgctggaccggggcaaccccacccccagcctgaagcccgtgaccctgcagcaggtgctgccgagcagcgcgccctccgagatgaagcggggcctgaagcgcgagggcggcgacctggcgcccaccgtgcagctaatggtgcccaagcggcagaggctggaggacgtgctggagaaaatgaaagtagaccccggcctgcagccggacatcagggtccgccccatcaagcaggtggcgccgggcctcggcgtgcagaccgtggacgtggtcatccccaccggcgcctcctcttccagcgccgccgccgccgccactagcaccgcggacatggagacgcagactagccccgccgccgccgccgccacctcctcggcggaggtacagacggacccctggatgccgccgccggcgaccgccccctcgcgcgcacgccgcgggcgcaggaagtacggtgccgccagcgcgctcatgcccgagtacgccttgcatccttccatcgcgcccacccccggctaccgaggctacagttaccgcccgcgaagagccaagggctccacccgccgcacccgccgcgccgccacctctacccgccgccgcagtcgccgccgccgccggcagcccgcgctggctccgatctccgtgagaagagtggcgcgcaacggggacaccttggtgctgcccagggcgcgctaccaccccagcatcgtttaaaaagcctgttgtggttcttgcagatatggccctcacttgccgcctccgtttcccggtgccgggataccgaggaagatcgcgccgcaggaggggtatggccggacgcggcctgagcggaggcagtcgccgcgcgcaccggcggcgacgcgccaccagccgacgcatgcgcggcggggtgctgcctctgctgatccccctgatcgccgcggcgatcggcgccgtgcccgggatcgcctccgtggccttgcaggcgtcccagaggcgttgacacagacttcttgcaagcttgcaaaaatatggaaaaaatccccccaataaaaaagtctagactctcacgctcgcttggtcctgtgactattttgtagaaaaaagatggaagacatcaactttgcgtcgctggccccgcgtcacggctcgcgcccgttcctgggacactggaacgatatcggcaccagcaacatgagcggtggcgccttcagttggggctctctgtggagcggcattaaaaatatcggttctgccgttaagaattacggcaccaaggcctggaacagcagcacgggccagatgttgagagacaagttgaaagagcagaacttccagcagaaggtggtggagggtctggcctcaggcatcaacggggtggtggacctggccaatcaggccgtgcaaaataagatcaacagcagactggacccccggccgccggtggaggaactgccgccggcgctggagacggtgtctcccgatgggcggggcgaaaagcgcccgcggcccgacagggaagagaccactctggtcacgcacaccgatgagccgcccccctacgaggaagccctgaagcaaggcttgcccaccactcggcccatcgcgcccatggccaccggggtggtgggccgccacacccccgccacgctggacctgcctcctcctcctgtttcttcttcggccgccgatgcgcagcagcagaaggcggcgctgcccggtccgcccgcggccgccccccgtcccaccgccagtcgagcgcccctgcgtcgcgcggccagcggcccccgcggggtcgctaggcacagcagcggcaactggcagaacacgctgaacagcatcgtgggtctgggggtgcagtccgtgaagcgccgccgatgctactgaatagcttagctaacggtgttgtatgtgtgtatgcgtcctatgtcaccgccagaggagctgctgagtcgccgccgttcgcgcgcccaccgccactaccaccgccggtaccactccagcgcccctcaagatggcgaccccatcgatgatgccgcagtggtcgtacatgcacatctcgggccaggacgcctcggagtacctgagccccgggctggtgcagttcgcccgcgccaccgacagctacttcagcctgagtaacaagtttaggaaccccacggtggcgcccacgcacgatgtgaccaccgaccggtcccagcgcctgacgctgcggttcatccccgtggaccgcgaggacaccgcgtactcttacaaggcgcggttcaccctggccgtgggcgacaaccgcgtgctggacatggcctccacctactttgacatccgcggcgtgctggacaggggccccaccttcaagccctactccggcaccgcctacaactccctggcccccaagggcgcccccaactcctgcgagtgggagcaattagaagaagcccaggccgctttggaagacgaagaattagaagaagacgaggaaccacaagatgaggcgcctgtgaaaaagacccatgtatacgctcaggcgcccctttctggagaacaaattactaaagacggtctgcaaatagggtcagataacacagaagctcagtctaagcctatatatgcagatcctacattccagcctgaacctcaaattggggaatcccaatggaatgaagcagatgctacagcagctgggggtagagtgctgaaaaaaaccactcctatgaagccatgctatggctcatatgcccgccctacaaactctaatggaggtcaaggtgtgctggtggctgatgataagggtgtccttcaatctaaagttgaaatgcaatttttttcaaccactactacgcttaatcagcgggcgggtaatgatacaaagccaaaactagtgctgtacagcgaggatgtgcacatggaaactccagacacacacatctcttacaagcctacaaaaagcgatgacaattcgaaagtcatgctgggtcaacagtccatgcccaacaggcccaactacatcgccttcagagacaactttatcgggctcatgtattacaacagcactggcaacatgggagtgctggcaggtcaggcctcacagttgaatgcagtggtggacctgcaagacagaaacacagaactgtcctaccagctcttgcttgattccatgggagacagaaccagatacttttccatgtggaatcaggcggtggacagctatgacccagatgtcagaattattgaaaatcatggaaccgaagacgaactgcccaactattgtttccctctgggaggcataggggtaactgacacttaccaggctattaagactaatggcaatggtcaaggagacccaacctgggaaaaagacacagagtttgcagaccgcaacgagataggggtgggaaacaacttcgccatggagattaacctcagtgccaacctgtggaggaacttcctctactccaacgtggccctgtacctgccagacaagcttaagtacaacccctccaacgtggaaatctctgacaaccccaacacctacgactacatgaacaagcgagtggtggccccggggctggtggactgctacatcaacctgggcgcgcgctggtccctggactacatggacaacgtcaaccccttcaaccaccaccgcaatgcgggcctgcgctaccgctccatgcttctgggcaacgggcgctacgtgcccttccacatccaggtgccccagaagttctttgccatcaagaacctcctcctcctgccgggctcctacacctacgagtggaacttcaggaaggatgtcaacatggtcctccagagctctctgggcaacgacctcagggtcgacggggccagcatcaagttcgagagcatctgcctctacgccaccttcttccccatggcccacaacacggcctccacgctcgaggccatgctcaggaacgacaccaacgaccagtccttcaacgactacctctccgccgccaacatgctctaccccatccccgccaacgccaccaacgtccccatctccatcccctcgcgcaactgggcggccttccgcggctgggccttcacccgccttaagaccaaggagaccccctccctgggctcgggtttcgacccctactacacttactcgggctccataccctacctggacggaaccttctacctcaaccacactttcaagaaggtctcggtcaccttcgactcctcggtcagctggccgggcaacgaccgcctgctcacccccaacgagttcgagatcaagcgctcggtcgacggggagggctacaacgtggcccagtgcaacatgaccaaggactggttcctcatccagatgctggccaactacaacatcggctatcagggcttctacatcccagagagctacaaggacaggatgtactccttctttaggaacttccagcccatgagccggcaggtggtggacgaaaccaagtacaaggactaccagcaggtgggcatcatccaccagcacaacaactcgggcttcgtgggctacctcgcccccaccatgcgcgagggacaggcctaccccgccaacttcccctacccgctcattggcaagaccgcggtcgacagcatcacccagaaaaagttcctctgcgaccgcaccctctggcgcatccccttctccagcaacttcatgtccatgggtgcgctcacggacctgggccagaacctgctctatgccaactccgcccacgcgctcgacatgaccttcgaggtcgaccccatggacgagcccacccttctctatgttctgttcgaagtctttgacgtggtccgggtccaccagccgcaccgcggcgtcatcgagaccgtgtacctgcgcacgcccttctcggccggcaacgccaccacctaaagaagcaagccgccaccgccaccacctgcatgtcgtcgggttccaccgagcaggagctcaaggccatcgtcagagacctgggatgcgggccctattttttgggcaccttcgacaaacgcttcccgggcttcgtcgccccgcacaagctggcctgcgccatcgtcaacacggccggccgcgagaccgggggcgtgcactggctggccttcgcctggaacccgcgctccaaaacatgctacctctttgaccccttcggattctcggaccagcggctcaagcagatctaccagttcgagtacgagggcctgctgcgccgcagcgccattgcctcctcgcccgaccgctgcgtcaccctcgagaagtccacccagaccgtgcaggggcccgactcggccgcctgcggtctcttctgctgcatgttcctgcacgccttcgtgcactggccccagagtcccatggaccgcaaccccaccatgaacttgctgacggggatccccaactccatgctccagagcccccaggccgcgcccaccctgcgccgcaatcaggagcggctctacagcttcctggagcgccactcgccctacttccgccgccacagcgcgcagatcaggggggccacctctttctgtcgcatgcaagagatgcaagggaaaatgcaatgatgtacacagacactttttcttttctcaataaatggcaactttatttatacacgctctctctcgggtattcatttccccaccacccaccacccgccgccgccgtaaccatctgctgctggcttttttaaaaatcgaaagggttctgccgggaatcgccgtgcgccacgggcagggacacgttgcggaactggtagcgggtgccccacttgaactcgggcaccaccatgcggggcaagtcggggaagttgtcggcccacaggccgcgggtcagcaccagcgcgttcatcaggtcgggcgccgagatcttgaagtcgcagttggggccgccgccctgcgcgcgcgagttgcggtacaccgggttgcaacactggaacaccagcagcgccggataattcacgctggccagcacgctccggtcggagatcagctcggcgtccaggtcctccgcgttgctcagcgcgaacggggtcagcttgggcacctgccgccccaggaagggagcgtgccccggcttggaattgcagtcgcagcgcagcgggatcagcaggtgcccgcggccggactcggcgttggggtacagcgcgcgcatgaaggcctccatctggcggaaggccatctgggccttggcgccctccgagaagaacatgccgcaggacttgcccgagaactggttcgcggggcagctcgcgtcgtgcaggcagcagcgcgcgtcggtgttggcgatctgcaccacgttgcgcccccaccggttcttcacgatcttggccttggaagcctgctccttcagcgcgcgctgcccgttctcgctggtcacatccatctcgatcacgtgctccttgttcaccatgctgctgccgtgcagacacttcagctcgccctccacctcggtgcagcggtgctgccacagcgcgcagcccgtgggctcgaaatgcttgtaggtcacctccgcgtaggactgcaggtaggcctgcaggaagcgccccatcatggtcacgaaggtcttgttgctgctgaaggtcagctgcagcccgcggtgctcctcgttcagccaggccttgcacacggccgccagcgcctccacctggtcgggcagcatcttgaagttcagcttcagctcattctccacatggtacttgtccatcagcgcgcgcgcagcctccatgcccttctcccaggccgacaccagcggcaggctcaaggggttcaccaccgtcgcagccgccgccgcgctttcgctttccgctccgctgttctcttcttcctcctcctcttcttcctcgccgcccgcgcgcagcccccgcaccacggggtcgtcttcctgcaggcgccgcaccgagcgcttgccgctcctgccctgcttgatgcgcacgggcgggttgctgaagcctaccatcaccagcgcggcctcttcttgctcgtcctcgctgtccactatgacctcgggggagggcgacctcagaaccgtggcgcgctgcctcttctttttcctgggggcgtttgcaagctccgcggccgcggccgccgccgaggtcgaaggccgagggctgggcgtgcgcggcaccagcgcgtcctgcgagccgtcctcgtcctcggactcgaggcggcagcgagcccgcttcttcgggggcgcgcggggcggcggcgggggcggcggcgacggagacggggacgagacatcgtccagggtgggaggacggcgggccgcaccgcgtccgcgctcgggggtggtttcgcgctggtcctcttcccgactggccatctcccactgctccttctcctataggcagaaagagatcatggagtctctcatgcaagtcgagaaggaggaggacagcctaaccaccaccgccccctctgagccctccgccgccaccgccgcggacgacgcgcctaccaccgccgccgccaccaccattaccaccctacccggcgacgcagccccgatcgagaaggaagtgttgatcgagcaggacccgggttttgtgagcgaagaggaggatgaggaggatgaaaaggagaaggataccgccgcctcagtgccaaaagaggataaaaagcaagaccaggacgacgcagagacagatgaggcagcaatcgggcggggggacgagaggcatgatgatgatgacggctacctagacgtgggagacgacgtgctgcttaagcacctgcaccgccagtgcgtcatcgtctgcgacgcgctgcaggagcgctgcgaagtgcccctggacgtggcggaggtcagccgcgcctacgagcggcacctcttcgcgccacacgtgccccccaagcgccgggagaacggcacctgcgagcccaacccgcgcctcaacttctacccggtcttcgcggtacccgaggtgctggccacctaccacatcttcttccaaaactgcaagatccccctctcctgccgtgccaaccgtacccgcgccgacaagacgctggccctgcggcagggcgcccacatacctgatatcgcctctctggaggaggtgcccaagatcttcgagggtctcggtcgcgacgagaaacgggcggcgaacgctctgcaaggagacagcgaaaacgagagtcactcgggggtgctggtggagctcgagggcgacaacgcgcgcctggccgtgctcaagcgcagcatcgaagtcacccacttcgcctacccggcgctcaacctgccccccaaggtcatgagtgtggtcatgagcgagctcatcatgcgccgcgcccagcccctggacgcggatgcaaacttgcaagagccctccgaggaaggcctgcccgcggtcagcgacgagcagctggcgcgctggctggagacccgcgaccccgcccagctggaggagcggcgcaagctcatgatggccgcggtgctcgtcaccgtggagctcgagtgtctgcagcgcttcttcggggaccccgagatgcagcgcaagctcgaggagaccctgcactacaccttccgccagggctacgtgcgccaggcctgcaagatctccaacgtggagctctgcaacctggtctcctacctgggcatcctgcacgagaaccgcctcgggcagaacgtcctgcactccaccctcaaaggggaggcgcgccgcgactacgtccgcgactgcgtctacctcttcctctgctacacgtggcagacggccatgggggtctggcagcagtgcctggaggagcgcaacctcaaggagctggagaagctcctcaggcgcgccctcagggacctctggacgggcttcaacgagcgctcggtggccgccgcgctggcggacatcatcttccccgagcgcctgctcaaaaccctgcagcagggcctgcccgacttcaccagccagagcatgctgcagaacttcaggaccttcatcctggagcgctcgggcatcctgccggccacctgctgcgcgctgcccagcgacttcgtgcccatcaggtacagggagtgcccgccgccgctctggggccactgctacctcttccagctggccaactacctcgcctaccactcggatctcatggaagacgtgagcggcgagggcctgctcgagtgccactgccgctgcaacctgtgcacgccccaccgctctctagtctgcaacccgcagctgctcagcgagagtcagattatcggtaccttcgagctgcagggtccctcgcccgacgaaaagtccgcggctccggggttgaaactcactccggggctgtggacttccgcctacctacgcaaatttgtacctgaagactaccacgcccacgagatcaggttttacgaagaccaatcccgcccgcccaaggcggagctcaccgcctgcgtcattacccagggccacatcctgggccaattgcaagccatcaacaaagcccgccaagagttcttgctgaaaaagggtcggggggtgtacctggacccccagtccggcgaggagctaaacccgctacccccgccgccgccccagcagcgggaccttgcttcccaggatggcacccagaaagaagcagccgccgccgccgccagcatacatgcttctggaggaagaggaggactgggacagtcaggcagaggaggtttcggacgaggacgaggaggaggaaatgatggaagactgggaggaggacagcctagacgaggaagcttcagaggccgaagaggtggcagacgcaacaccatcaccctcggccgcagccccctcgccggcgcccccgaaatcctccgaccccagcagcagcgctataacctccgctcctccggcgccggcgcccacccgcagcagacccaaccgtagatgggacactacaggaaccggggtcggtaagtccaagtgccccccagcgccgcccccgcaacaggagcaacagcagcagcagcggcgacagggctaccgctcgtggcgcggacacaagaacgccatagtcgcctgcttgcaagactgcgggggcaacatctccttcgcccgccgcttcctgctcttccaccacggggtggcttttccccgcaatgtcctgcattactaccgtcatctctacagcccctactgcggcggcggcggcgacccagagggagcggcggcagcagcagcagcagcgccagccacagcggcgaccacctaggaagacctccgcgggcaagacggcgggagccgggagacccgcggcggcggcggtagcggcggcggcgggcgcactgcgcctctcgcccaacgaacccctctcgacccgggagctcagacacaggatcttccccactctgtatgctatcttccagcagagcagaggccaggaacaggagctgaaaataaaaaacagatctctgcgctccctcacccgcagctgtctgtatcacaaaagcgaagatcagcttcggcgcacgctggaggacgcggaggcactcttcagcaaatactgcgcgctgactcttaaggactagccgcgcgcccttctcgaatttaggcgggagaaagactacgtcatcgccgaccgccgcccagcccacccagccgacatgagcaaagagattcccacgccctacatgtggagctaccagccgcagatgggactcgcggcgggagcggcccaagactactccacccgcatgaactacatgagcgcggggccccacatgatctcacgggttaatgggatccgcgccgagcgaaaccaaatactgctggaacaggcggccataaccgccacaccccgtcatgacctcaatccccgaaattggcccgccgccctcgtgtaccaggaaaccccctctgccaccaccgtggtacttccgcgtgacacccaggccgaagtccagatgactaactcaggggcgcagctcgcgggcggctttcgtcacggggtgcggccgcaccggccgggtatattacacctggcgatcagaggccgaggtattcagctcaacgacgagtcggtgagctcttcgctcggtctccgtccggacggaaccttccagatcgccggatcaggtcgctcctcattcacgcctcgccaggcgtacctgactctgcagacctcctcctcggagcctcgctccggcggcatcggcaccctccagttcgtggaggagttcgtgccctcggtctacttcaaccccttctcgggacctcccggacgctatcccgaccagttcatcccgaactttgacgcggtgaaggactcggcggacggctacgactgaatgtcaagtgctgaggcagagagcgttcgcctgaaacacctcgagcactgccgccgcttcgcctgcttcgcccgcagctccggtgagttctgctactttcagctgcccgaggagcataccgaggggccggcgcacggcgtccgcctaaccacccagggcgaggttacctgtacccttatccgggagtttaccctccgtcccctgctagtggagcgggagcggggttcttgtgtcataactatcgcctgcaactgccctaaccctggattacatcaagatctttgttgtcacctgtgcgctgagtataataaacgctgagatcagactctactggggctcctgtcgccatcctgtgaacgccaccgtcttcacccaccccgagcagccccaggcgaacctcacctgcggcctgcgtcggagggccaagaagtacctcacctggtacttcaacggcaccccctttgtggtttacaacagcttcgaccaggacggagttgccttgagagacgacctttccggtctcagctactccattcacaagaacaccaccctccacctcttccctccctacctgccgggaacctacgagtgcgtcaccggccgctgcacccacctcatccgcctgatcgtaaaccagacctttccgggaacacacctcttccccagaacaggaggtgagctcaggaaaccccctggggcccagggcggagacttaccttcgacccttgtggggttaggattttttatcgccgggttgctggctctcctgatcaaagcttccttgagatttgttctctccctttacttttatgaacagctcaacttctaataacgctaccttttctcaggaatcgggtagtaacttctcttctgaaatcgggctgggtgtgctgcttactctgttgatttttttccttatcatacttagccttctgtgcctcaggctcgccgcctgctgcgcacatatctacatctacagccggttgcttaactgctggggtcgccatccaagatgaacggggctcaggtgctatgtctgctggccctggtggcctgcagtgccgccgtcaattttgaggaacccgcttgcaatgtgactttcaagcctgaaggcgcacattgcaccactctggttaaatgtgtgacctctcatgacaaactgctcatcgcctacaaaaacaaaacaggcgagttcgcggtctatagcgtgtggcaacccggagaccataataactactcagtcaccgtcttcgagggtgcggagtctaagaaattcgattacacctttcccttcgaggagatgtgtgaagcggtcatgtacctgtccaaacagtacaagctgtggccccccacccccgaggcgtgtgtggaaaacactgggtctttctgctgtctctctctgacaatcactgtgcttgctctaatctgcacgctgctgtacatgaaattcaggcagaggcgaatctttatcgatgagaaaaaaatgccttgatcgctaacaccggctttctgtctgcagaatgaaagcaatcacctccctactaatcagcaccaccctccttgcgattgcccatgggttgacacgaatcgaagtgccagtggggtccaatgtcaccatggtgggccccgccggcaattcctccctgatgtgggaaaaatatgtccgtaatcaatgggatcattactgctctaatcgaatctgtatcaagcccagagccatctgcgacgggcaaaatctaactttgattgatgtgcaaatgacggatgctgggtactattacgggcagcggggagaaatgattaattactggcgaccccacaaggactacatgctgcatgtagtcaaggcagtccccactactaccacccccaccactaccactcccaccactcccactactaccacccccaccactactactagcactgctactaccgctgcccgcaaagctattacccgcaaaagcaccatgcttagcaccaagccccattctcactcccacgccggcgggcccaccggtgcggcctcagaaaccaccgagctttgcttctgccaatgcactaacgccagcgcccacgaactgttcgacctggagaatgaggatgatgaccagctgagctccgcttgcccggtcccgctgcccgcagagccggtcgccctgaagcagctcggtgatccatttaatgactctcctgtttatccctctcccgaatacccgcccgactctaccttccacatcacgggcaccaacgaccccaacctctccttctacctgatgctgctgctttgtatctctgtggtatcttccgcgctcatgttactgggcatgttctgctgcctcatctgccgcagaaagagaaagtctcgctctcagggccaaccactgatgcccttcccctaccccccagattttgcagataacaagatatgagcacgctgctgacactaaccgctttactcgcctgcgctctaacccttgtcgcttgcgaatccagataccacaatgtcacagttgtgacaggagaaaatgttacattcaactccacggccgacacccagtggtcatggagccaccacggtagctatttagacatctgcaatagctccacctcccctaacatgtcctttcccaagtaccactgcaatgccagcctgtttaccctcttcaacgcctccacctcggacaatggactctatgtaggctatgtgacacccggtgggcagggaaagactcatgcctacaacctgcaagttcgccacccctccaccaccgccaccacctctgccgcccctacccgcagcagcagcatcagcagcagcagattcctgactttaatcctagccagctcaacaaccaccgctgagaccacccaggccacctacagctccgcgcccgaaaccacccacacccaccacccagagacgaccgcggcctccagcgaccagatgtcggccaacatcaccgcctcgggtcttgaacttgcttcaacccccaccccaaaaccagtggatgcagccgacgtctccgccctcgtcaatgactgggcggggctgggaatgtggtggttcgccataggcatgatggcgctctgcctgcttctgctctggctcatctgctgcctcaaccgcaggcgggccagacccatctatagacccatcattgttctcaaccccgctgatgatgggatccatagattggatggtctgaaaaacctacttttctcttttacagtatgataaattgagacatgcctcgcattttcatgtacttgacacttctcccactttttctggggtgttctacgctggccgccgtctctcacctcgaggtagactgcctcacacccttcactgtctacctgatttacggattggtcaccctcactctcatctgcagcctaatcacagtagtcatcgccttcatccagtgcattgactacatctgtgtgcgcctcgcatacctgagacaccacccgcagtaccgagacaggaacattgcccaactcctaagactgctctaatcatgcataagactgtgatctgcctcctcatcctcctctccctgcccgctctcgtctcatgccagcccaccacaaaacctccacgaaaaagacatgcctcctgtcgcttgagccaactgtggaatattcccaaatgctacaatgaaaagagcgagctttccgaagcctggctatatgcggtcatgtgtgtccttgtcttctgcagcacaatctttgccctcatgatctacccccactttgatttgggatggaatgcggtcgatgccatgaattaccctacctttcccgcgcccgatatgattccactccgacaggttgtggtgcccgtcgccctcaatcaacgccccccatcccctacacccactgaggtcagctactttaatctaacaggcggagatgactgacactctagatctagaaatggacggcatcggcaccgagcagcgtctcctacagaggcgcaagcaggcggctgaacaagagcgcctcaatcaggagctccgagatctcattaacctgcaccagtgcaaaaaaggcatcttttgcctggtcaagcaggccgatgtcacctacgagaaaaccggtaacagccaccgcctcagctacaagctgcccacccaacgccagaagttggtgctcatggtgggtcagaatcccatcaccgtcacccagcactcggtggagaccgaggggtgtctgcactccccctgtcagggtccggaagacctctgcaccctggtaaagaccctgtgtggtcttagagatctaatcccctttaactaatcaaacactggaatcaataaaaagaatcacttactttaaatcagtcagcaggtctctgtccactttattcagcagcacctccttcccctcctcccaactctggtactccaaacgcctcctggcggcaaacttcctccacaccctgaagggaatgtcagattcttgctcctgtccctccgcacccactatcttcatgttgttgcagatgaagcgcgccaaaacgtctgacgagaccttcaaccccgtgtacccctatgacacggaaaacgggcctccctccgtccctttcctcacccctcccttcgtgtcccccgacggatttcaagaaagcccccccggggtcctgtctctgcgcctgtcagagcccctggtcacttcccatggcatgctcgccctgaaaatgggaagtggcctctccctggatgacgccggcaacctcacctctcaagatgtcaccactgtcacccctcccctcaaaaaaaccaagaccaacctcagcctcgacacctcagcccccctgactgtcagctctgggtccctcaccgtcgcggccgccgctccattggcggtggccggcacctctctcaccatgcaatctcaggcccccttaacggtgcaagatgcaaaactcggcctggccacccagggacccctgaccgtgtctgaaggcaaactcaccttgcagacatcggctccactgacggccgctgacagcagcaccctcactgttagtgccacacctcccctcagcacaagcaatggtagtttgagcattgacatgcaggccccaatttataccaccaatggaaaactggcacttaacattggtgctcccctgcatgtggtagacaccctaaatgcactaactgtagtaactggccagggtcttaccataaatggaagagccctgcaaactagagtcacgggtgccctcagttatgacacagaaggcaacatccaactgcaagccggagggggtatgcgcattgacaataatggtcaacttatccttaatgtagcttatccatttgatgctcaaaacaacctcagccttagacttggccaaggtcccctaattgttaactctgcccacaacttggatcttaaccttaacagaggcctttacttatttacatctggaaacacgaaaaaactggaagttaacataaaaacagccaaaggtctattttacgatggcaccgctatagcaatcaatgcaggtgacgggctacagtttgggtctggatcagatacaaatccattgcaaactaaacttggattggggctggaatatgactccaacaaagctataatcaccaaacttggaactggcctaagctttgacaacacaggtgccatcacagtaggcaacaaaaatgatgacaagcttaccttgtggaccacaccagacccctccccaaactgcagaattaattcagaaaaagatgctaaactcacactagttttgactaaatgcggcagtcaggtgttagccagcgtttctgttttatctgtaaaaggcagccttgcccccattagtggcacagtaactagcgcccagattgttttaagatttgatgaaaacggagttttattgagcaattcttctcttgacccccaatactggaactatagaaaaggcgattctacagaaggcagtgcatataccaatgctgtgggatttatgcccaacctcacagcataccctaaaacacagagccagactgctaaaagcaacattgtaagtcaagtttacttgaatggggacaaaacaaaacccatgaccctaaccatcaccctcaatggaactaatgaaacaggggatgctacagtaagcacgtactccatgtcattttcatggaactggaatggaagtaattacattaatgacaccttccaaaccaactcctttaccttctcctacatcgcccaagaataaaaaagcatgacgctttgttctctgattcagtgtgtttcttttatttttttcaattacaacaaaatcattcaagtcattctccatttagcttaatagacccagtagtgcaaagccccatactagcttatttcagacagtataaatttaaccataccttttgatttcaatattaaaaaaatcatcacaggatcctagtcgtcaggccgccccctccctgccaagacacagaatacacaatcctctccccccggctggctttaaacaacaccatctggttggtgacagacaggttcttcggggttatattccacacggtctcctggcgggccaggcgctcgtcggtgatgctgataaactctccgggcagctcgctcaagttcacgtcgctgtccagcggctgaacctcatgctgacgcggtaactgcgcgaccggctgctgaacaaacggaggccgcgcctacaagggggtagagtcataatcctccgtcaggatagggcggttatgcagcagcagcgagcgaatcatctgctgccgccgccgctccgtccggcaggaaaacaacatcccggtggtctcctccgctataatccgcaccgcccgcagcataagcctcctcgttctccgcgcgcagcaccgcaccctgatctcgctcaggttggcacagtaggtacagcacatcaccacgatgttattcatgatcccacagtgcaaggcgctgtatccaaagctcatgcccggaaccaccgcccccacgtgaccgtcgtaccagaagcgcaggtaaatcaagtgccgacccctcatgaacgtgctggacataaacatcacctccttgggcatgttgtaattcaccacctcccggtaccagatgaatctctgattgaacacggccccttccaccaccatcctgaaccaagaggctaggacctgcccaccggctatgcactgcagggaaccagggttggaacaatgacaatgaagactccagggctcgtaaccgtggatcatccggctgctgaagacatcgatgttggcgcaacacagacacacgtgcatacacttcctcatgattagcagctcctccctcgtcaggatcatatcccaagggataacccattcttgaatcaacgtaaagcccacagagcagggaaggcctcgcacataactcacgttgtgcatggtcagcgtgttgcattccggaaacagcggatgatcctccaatatcgaggcgcgggtctcgttctcacagggaggtaaaggggccctgctgtacggactgtggcgggacgaccgagatcgtgttgagcgtaacgtcatggaaaagggaacgccggacgtggtcatacttcttgaagcagaaccaggctcgcgcgtgacagacctccttgcgtctacggtctcgccgcttaactcgctccgtgtgatagttgtagtacagccactctctcaaagcgtcgaggcgacacctggcgtcaggatgtatgtagactccgtcttgcaccgcggccctgataatatccaccaccgtagaataagccacaccaagccaagcaatacactcgctctgcgagcggcagacaggaggagcggggagagacggaaggaccatcataaaattttaaagaatattttccaatatttcgaaatcaagatctaccaaatggcagcgctcccctccactggcgcggtcaaactctacggccaaagaacagataacggcatttttaagatgttcccggacggcgtctaaaagacaaaccgctctcaagtcgacataaattataagccaaaagccatcgggttcaagatccactatggacgcgccggcggcgtccaccaaacccaaataattttcttctctccagcgcagcaaaatcccagtaagcaactccctgatattaagatgaaccatgccaaaaatctgttcaagagcgccctccaccttcattctcaagcagcgcatcatgattgcaaaaattcaggttcctcagacacctgtatgagattcaaaaagggaatattaacaaaaattcctctgtcgcgcagatcccttcgcagggcaagctgaacataatcagacaggtctgaacgaaccagcgaggccaaatccccgccaggaaccagatccagagaccctatgctgattatgacgcgcatactcggggctatgctaaccagcgtagcgccgatgtaggcgtgctgcatgggcggcgaaataaaatgcaaggtgctggttaaaaaatcaggcaaagcctcgcgcaaaaaagctaagacatcataatcatgctcatgcaggtagttgcaggtaagctcaggaaccaaaacggaataacacacgattttcctctcaaacatgacttccaggtgactgcataagaaaaaattataaataataaatattaattaaataaattaaacattggaagcctgtctcacaacaggaaaaaccactctgatcaacataagacgggccacgggcatgcccgcgtgaccataaaaaaatcggtctccgtgattacaaagcaccacagatagctccccggtcatgtcgggggtcatcatgtgagactgtgtatacacgtccgggctgttgacatcggtcaaagaaagaaatcgagctacatagcccggaggaatcaacacccgcacgcggaggtacagcaaaacggtccccataggaggaatcacaaaattagtaggagaaaaaaaaacataaacaccagaaaaaccctcctgccgaggcaaaacagcgccctcccgttccaaaacaacataaagcgcttccacaggagcagccatgacaaagacccgagtcttaccaggaaaattttaaaaaagattcctcaacgcagcaccagcaccaacacctgtcagtgtaaaatgccaagcgccgagcgagtatatataggaataaaaagtgacgtaaacggttaaagtccagaaaacgcccagaaaaaccgcacgcgaacctacgccccgaaacgaaagccaaaaaacagtaaacacgccctttcggcgtcaacttccgctttcccacggtacgtcacttccgcatataggaaaactacgctacccatcatgcaagaagccacgccccaaaacacgtcacacctcccggcccgccccgcgccgccgccccgccccgcgcctcccaactccgccccgctccgcccacctcattatcatattggcttcaatccaaaataaggtatattattgatgatg

SEQ ID NO: 65 - protein, 217 aa, Unknown
  Synthetic Construct
MFNCMVCLIGAGFVGYISFPGLNLVTLDLMEAWECLESFAEVRALLEESSNNTSGWWRYFWGSPQAKLVCRIKEDYKWEFEQLLKSCGELLDSLNLGHQALFQDKIIRTLDFSTPGRIAAGVAFLAFLKDKWSEETHLSSGYVLDFLAIQLWRAWIRHKNRMQLLSSVRPLLIQPEEQQTGPEDRARPEPEERAPAAAPERSAWNLGAGLNGHPHRE

SEQ ID NO: 66 - protein, 147 aa, Unknown; identical to SEQ ID NO: 35
  Synthetic Construct

SEQ ID NO: 67 - protein, 420 aa, Unknown
  Synthetic Construct
MHPVLRQMRPPPQQQQQQHQQERHQQQRESCRAPSPTLGGPATSASAAVSGAGGGGLADDPEEPPRRRARQYLDLEEGEGLARLGAPSPERHPRVQLKRDSREAYVPRQNLFRDRAGEEPEEMRDRRFAAGRELRQGLNRERLLREEDFEPDARTGISPARAHVAAADLVTAYEQTVNQEINFQKSFNNHVRTLVAREEVTIGLMHLWDFVCALEQNPNSKPLTAQLFLIVQHSRDNEAFRDALLNITEPEGRWLLDLINILQSIVVQERSLSLADKVAAINYSMLSLGKFYARKIYQTPYVPIDKEVKIDGFYMRMALKVLTLSDDLGVYRNERIHKAVSVSRRRELSDRELMHSLQRALAGAGSGDREAESYFEAGADLRWVPSRRALEAAGARREDYADEEEEDDEEYELEEGEYLD

SEQ ID NO: 68 - protein, 590 aa, Unknown
  Synthetic Construct
MQDPNVVDPALRAALQSQPSGLNSTDDWRQVMDRIMSLTARNPDAFRQQPQANRLSAILEAVVPARANPTHEKVLAIVNALAENRAIRPDEAGLVYDALLQRVARYNSGNVQTNLDRLVGDVREAVAQRERAERQGNLGSMVALNAFLSTQPANVPRGQEDYTNFVSALRLMVTETPQSEVYQSGPDYFFQTSRQGLQTVNLSQAFKNLRGLWGVKAPTGDRATVSSLLTPNSRLLLLLIAPFTDSGSVSRETYLGHLLTLYREAIGQTQVDEHTFQEITSVSRALGQEDTGSLEATLNYLLTNRRQKIPSLHSLTTEEERILRYVQQSVSLNLMRDGVTPSVALDMTARNMEPGMYAAHRPYINRLMDYLHRAAAVNPEYFTNAILNPHWLPPPGFYSGGFEVPEANDGFLWDDMDDSVFSPRPQALAEASLLRLPKKEESRRPSSAAASLSELGAAAARPGSLGGSPFPSLVGSLQSGRTTRPRLLGEDEYLNNSLMQPVREKNLPPAFPNNGIESLVDKMSRWKTYAQEHRDSPVLRPPTRRQRHDRQRGLVWDDEDSADDSSVLDLGGSGGNPFAHLRPRLGRMFQ

SEQ ID NO: 69 - protein, 586 aa, Unknown
  Synthetic Construct
MRRAAMYHEGPPPSYESVVGAAAASPFASQLEPPYVPPRYLRPTGGRNSIRYSELAPLYDTTRVYLVDNKSADVASLNYQNDHSNFLTTVIQNNDYTPSEASTQTINLDDRSHWGGDLKTILHTNMPNVNEFMFTNKFKARVMVSRSHTKDDRVELKYEWVEFELPEGNYSETMTIDLMNNAIVEHYLKVGRQNGVLESDIGVKFDTRNFRLGLDPVTGLVMPGVYTNEAFHPDIILLPGCGVDFTYSRLSNLLGIRKRQPFQEGFRITYEDLEGGNIPALLDVEAYQDSLKEEEAGEGSGGGGGAGQEEGGASSEASADAAAADTAAEAEAADPAMVVEEEKDMNDEAVRGDTFVTRGEEKKAEAEAAAEEAAAAAAAVEAAAEAEKPPKEPVIKPLTEDSKKRSYNVLKDSTNTEYRSWYLAYNYGDPATGVRSWTLLCTPDVTCGSEQVYWSLPDMMQDPVTFRSTRQVSNFPVVGAELLPVHSKSFYNDQAVYSQLIRQFTSLTHVFNRFPENQILARPPAPTITTVSENVPALTDHGTLPLRNSIGGVQRVTVTDARRRTCPYVYKALGIVSPRVLSSRTF

SEQ ID NO: 70 - protein, 199 aa, Unknown; identical to SEQ ID NO: 39
  Synthetic Construct

SEQ ID NO: 71 - protein, 367 aa, Unknown
  Synthetic Construct
MSKRKIKEEMLQVVAPEIYGPPKKEEQDFKPRKIKRVKKKKKDDDDGEVEFLRATAPRRPLQWKGRRVKRVLRPGTAVVFTPGERSTRTFKRVYDEVYGDEDLLEQANDRSGEFAYGKRHRAMEKDEVLALPLDRGNPTPSLKPVTLQQVLPSSAPSEMKRGLKREGGDLAPTVQLMVPKRQRLEDVLEKMKVDPGLQPDIRVRPIKQVAPGLGVQTVDVVIPTGASSSSAAAAATSTADMETQTSPAAAAATSSAEVQTDPWMPPPATAPSRARRGRRKYGAASALMPEYALHPSIAPTPGYRGYSYRPRRAKGSTRRTRRAATSTRRRSRRRRRQPALAPISVRRVARNGDTLVLPRARYHPSIV

SEQ ID NO: 72 - protein, 80 aa, Unknown; identical to SEQ ID NO: 41
  Synthetic Construct

SEQ ID NO: 73 - protein, 259 aa, Unknown; identical to SEQ ID NO: 42
  Synthetic Construct

SEQ ID NO: 74 - protein, 957 aa, Unknown; identical to SEQ ID NO: 43
  Synthetic Construct

SEQ ID NO: 75 - protein, 211 aa, Unknown
  Synthetic Construct
MSSGSTEQELKAIVRDLGCGPYFLGTFDKRFPGFVAPHKLACAIVNTAGRETGGVHWLAFAWNPRSKTCYLFDPFGFSDQRLKQIYQFEYEGLLRRSAIASSPDRCVTLEKSTQTVQGPDSAACGLFCCMFLHAFVHWPQSPMDRNPTMNLLTGIPNSMLQSPQAAPTLRRNQERLYSFLERHSPYFRRHSAQIRGATSFCRMQEMQGKMQ

SEQ ID NO: 76 - protein, 830 aa, Unknown
  Synthetic Construct
MESLMQVEKEEDSLTTTAPSEPSAATAADDAPTTAAATTITTLPGDAAPIEKEVLIEQDPGFVSEEEDEEDEKEKDTAASVPKEDKKQDQDDAETDEAAIGRGDERHDDDDGYLDVGDDVLLKHLHRQCVIVCDALQERCEVPLDVAEVSRAYERHLFAPHVPPKRRENGTCEPNPRLNFYPVFAVPEVLATYHIFFQNCKIPLSCRANRTRADKTLALRQGAHIPDIASLEEVPKIFEGLGRDEKRAANALQGDSENESHSGVLVELEGDNARLAVLKRSIEVTHFAYPALNLPPKVMSVVMSELIMRRAQPLDADANLQEPSEEGLPAVSDEQLARWLETRDPAQLEERRKLMMAAVLVTVELECLQRFFGDPEMQRKLEETLHYTFRQGYVRQACKISNVELCNLVSYLGILHENRLGQNVLHSTLKGEARRDYVRDCVYLFLCYTWQTAMGVWQQCLEERNLKELEKLLRRALRDLWTGFNERSVAAALADIIFPERLLKTLQQGLPDFTSQSMLQNFRTFILERSGILPATCCALPSDFVPIRYRECPPPLWGHCYLFQLANYLAYHSDLMEDVSGEGLLECHCRCNLCTPHRSLVCNPQLLSESQIIGTFELQGPSPDEKSAAPGLKLTPGLWTSAYLRKFVPEDYHAHEIRFYEDQSRPPKAELTACVITQGHILGQLQAINKARQEFLLKKGRGVYLDPQSGEELNPLPPPPPQQRDLASQDGTQKEAAAAAASIHASGGRGGLGQSGRGGFGRGRGGGNDGRLGGGQPRRGSFRGRRGGRRNTITLGRSPLAGAPEILRPQQQRYNLRSSGAGAHPQQTQP

SEQ ID NO: 77 - protein, 227 aa, Unknown; identical to SEQ ID NO: 46
  Synthetic Construct

SEQ ID NO: 78 - protein, 105 aa, Unknown; identical to SEQ ID NO: 57
  Synthetic Construct

SEQ ID NO: 79 - protein, 159 aa, Unknown
  Synthetic Construct
MNGAQVLCLLALVACSAAVNFEEPACNVTFKPEGAHCTTLVKCVTSHDKLLIAYKNKTGEFAVYSVWQPGDHNNYSVTVFEGAESKKFDYTFPFEEMCEAVMYLSKQYKLWPPTPEACVENTGSFCCLSLTITVLALICTLLYMKFRQRRIFIDEKKMP

SEQ ID NO: 80 - protein, 303 aa, Unknown
  Synthetic Construct
MKAITSLLISTTLLAIAHGLTRIEVPVGSNVTMVGPAGNSSLMWEKYVRNQWDHYCSNRICIKPRAICDGQNLTLIDVQMTDAGYYYGQRGEMINYWRPHKDYMLHVVKAVPTTTTPTTTTPTTPTTTTPTTTTSTATTAARKAITRKSTMLSTKPHSHSHAGGPTGAASETTELCFCQCTNASAHELFDLENEDDDQLSSACPVPLPAEPVALKQLGDPFNDSPVYPSPEYPPDSTFHITGTNDPNLSFYLMLLLCISVVSSALMLLGMFCCLICRRKRKSRSQGQPLMPFPYPPDFADNKI

SEQ ID NO: 81 - protein, 90 aa, Unknown; identical to SEQ ID NO: 50
  Synthetic Construct

SEQ ID NO: 82 - protein, 133 aa, Unknown; identical to SEQ ID NO: 51
  Synthetic Construct

SEQ ID NO: 83 - protein, 595 aa, Unknown
  Synthetic Construct
MSDSCSCPSAPTIFMLLQMKRAKTSDETFNPVYPYDTENGPPSVPFLTPPFVSPDGFQESPPGVLSLRLSEPLVTSHGMLALKMGSGLSLDDAGNLTSQDVTTVTPPLKKTKTNLSLDTSAPLTVSSGSLTVAAAAPLAVAGTSLTMQSQAPLTVQDAKLGLATQGPLTVSEGKLTLQTSAPLTAADSSTLTVSATPPLSTSNGSLSIDMQAPIYTTNGKLALNIGAPLHVVDTLNALTVVTGQGLTINGRALQTRVTGALSYDTEGNIQLQAGGGMRIDNNGQLILNVAYPFDAQNNLSLRLGQGPLIVNSAHNLDLNLNRGLYLFTSGNTKKLEVNIKTAKGLFYDGTAIAINAGDGLQFGSGSDTNPLQTKLGLGLEYDSNKAIITKLGTGLSFDNTGAITVGNKNDDKLTLWTTPDPSPNCRINSEKDAKLTLVLTKCGSQVLASVSVLSVKGSLAPISGTVTSAQIVLRFDENGVLLSNSSLDPQYWNYRKGDSTEGSAYTNAVGFMPNLTAYPKTQSQTAKSNIVSQVYLNGDKTKPMTLTITLNGTNETGDATVSTYSMSFSWNWNGSNYINDTFQTNSFTFSYIAQE

SEQ ID NO: 84 - DNA, 1530 bp, Unknown
  Simian adenovirus 42.2
  CDS (1)..(1524): E1b\55K
atggagcgaagagacccacttgagttcgggatacgtcctggattttctggccatacaactgtggagagcatggatcaggcacaagaacagaatgcaactgttgtcttccgtccgtccgttgctgattcagccggaggagcagcagaccgggccggaggaccgggctcgtccggaaccagaggagagggcgcccgcggcggcgccggagaggagcgcgtggaacctgggagccggcctgaacggccatccacatcgggagtgaatgttggacaggtggcggatctctttccagaactgcgacgaatcttgactattagggaggatggacaatttgttaagggccttaagagggagcggggggcttctgaacataacgaggaggccagtaatttagcttttagtctgatgaccagacaccgtcccgagtgcattacttttcagcagattaaagataattgtgccaatgagttagatctgctgggtcagaagtacagcatagagcagttgaccacttactggttgcagccgggtgatgatctggaggaagctattagggtgtatgccaaggtggccctgaggcccgattgcaagtacaagctcaaggggctggtgaatatcaggaattgttgctacgtttctgggaacggggcggaggtggagatagagaccgatgacagggtggcctttaggtgcagcatgatgaatatgtggcctggggtgctgggcatggacggggtggtgattatgaatgtgaggttcacggggcccaattttaatggcacggtgttcctgggcaacaccaacttggtgctgcacggggtgagcttctatggctttaacaacacctgtgtggaggcctggaccgatgtgaaggtccgtggctgtgccttctacggatgttggaaggcggtagtgtgtcgccccaagagcaggagttccattaaaaaatgcttgtttgagaggtgcaccctgggggtgctggcggagggcaactgtcgggtgcgccacaatgtggcctccgaatgcggttgcttcatgctagtcaagagcgtggcggttatcaagcataacatggtgtgcggcaacagcgaggacaaggcctcgcagatgctgacctgctcggatggcaactgccacttactgaagaccgtacatataaccagccacagccgcaaggcctggcccgtgttcgagcacaacgtgttgacccgctgctctttgcatctgggcaacaggaggggtgtgttcctgccctatcaatgcaacttgagccacaccaaggtcttgctagagcccgaaagcatgtccaaggtgaacctgaacggggtgtttgacatgaccctgaagatatggaaggtgctgaggtacgacgagaccaggtctcggtgcaggccctgcgagtgcgggggcaagcatatgaggaaccagcctgtgatgctggatgtgaccgaggagctgaggcctgaccacttggttctggcctgcaccagggccgagtttggttctagcgatgaagacacagactgaggt

SEQ ID NO: 85 - protein, 508 aa, Unknown
  Synthetic Construct
MERRDPLEFGIRPGFSGHTTVESMDQAQEQNATVVFRPSVADSAGGAADRAGGPGSSGTRGEGARGGAGEERVEPGSRPERPSTSGVNVGQVADLFPELRRILTIREDGQFVKGLKRERGASEHNEEASNLAFSLMTRHRPECITFQQIKDNCANELDLLGQKYSIEQLTTYWLQPGDDLEEAIRVYAKVALRPDCKYKLKGLVNIRNCCYVSGNGAEVEIETDDRVAFRCSMMNMWPGVLGMDGVVIMNVRFTGPNFNGTVFLGNTNLVLHGVSFYGFNNTCVEAWTDVKVRGCAFYGCWKAVVCRPKSRSSIKKCLFERCTLGVLAEGNCRVRHNVASECGCFMLVKSVAVIKHNMVCGNSEDKASQMLTCSDGNCHLLKTVHITSHSRKAWPVFEHNVLTRCSLHLGNRRGVFLPYQCNLSHTKVLLEPESMSKVNLNGVFDMTLKIWKVLRYDETRSRCRPCECGGKHMRNQPVMLDVTEELRPDHLVLACTRAEFGSSDEDTD

SEQ ID NO: 86 - DNA, 6020 bp, Unknown
  Simian adenovirus 42.2
  CDS (9)..(635): 22K
  CDS (1985)..(2539): E3\CR1-alpha
  CDS (4142)..(4948): E3\CR1\gamma
  CDS (5632)..(6015): E3\14.7K
ttcccaggatggcacccagaaagaagcagccgccgccgccgccagcatacatgcttctggaggaagaggaggactgggacagtcaggcagaggaggtttcggacgaggacgaggaggaggaaatgatggaagactgggaggaggacagcctagacgaggaagcttcagaggccgaagaggtggcagacgcaacaccatcaccctcggccgcagccccctcgccggcgcccccgaaatcctccgaccccagcagcagcgctataacctccgctcctccggcgccggcgcccacccgcagcagacccaaccgtagatgggacactacaggaaccggggtcggtaagtccaagtgccccccagcgccgcccccgcaacaggagcaacagcagcagcagcggcgacagggctaccgctcgtggcgcggacacaagaacgccatagtcgcctgcttgcaagactgcgggggcaacatctccttcgcccgccgcttcctgctcttccaccacggggtggcttttccccgcaatgtcctgcattactaccgtcatctctacagcccctactgcggcggcggcggcgacccagagggagcggcggcagcagcagcagcagcgccagccacagcggcgaccacctaggaagacctccgcgggcaagacggcgggagccgggagacccgcggcggcggcggtagcggcggcggcgggcgcactgcgcctctcgcccaacgaacccctctcgacccgggagctcagacacaggatcttccccactctgtatgctatcttccagcagagcagaggccaggaacaggagctgaaaataaaaaacagatctctgcgctccctcacccgcagctgtctgtatcacaaaagcgaagatcagcttcggcgcacgctggaggacgcggaggcactcttcagcaaatactgcgcgctgactcttaaggactagccgcgcgcccttctcgaatttaggcgggagaaagactacgtcatcgccgaccgccgcccagcccacccagccgacatgagcaaagagattcccacgccctacatgtggagctaccagccgcagatgggactcgcggcgggagcggcccaagactactccacccgcatgaactacatgagcgcggggccccacatgatctcacgggttaatgggatccgcgccgagcgaaaccaaatactgctggaacaggcggccataaccgccacaccccgtcatgacctcaatccccgaaattggcccgccgccctcgtgtaccaggaaaccccctctgccaccaccgtggtacttccgcgtgacacccaggccgaagtccagatgactaactcaggggcgcagctcgcgggcggctttcgtcacggggtgcggccgcaccggccgggtatattacacctggcgatcagaggccgaggtattcagctcaacgacgagtcggtgagctcttcgctcggtctccgtccggacggaaccttccagatcgccggatcaggtcgctcctcattcacgcctcgccaggcgtacctgactctgcagacctcctcctcggagcctcgctccggcggcatcggcaccctccagttcgtggaggagttcgtgccctcggtctacttcaaccccttctcgggacctcccggacgctatcccgaccagttcatcccgaactttgacgcggtgaaggactcggcggacggctacgactgaatgtcaagtgctgaggcagagagcgttcgcctgaaacacctcgagcactgccgccgcttcgcctgcttcgcccgcagctccggtgagttctgctactttcagctgcccgaggagcataccgaggggccggcgcacggcgtccgcctaaccacccagggcgaggttacctgtacccttatccgggagtttaccctccgtcccctgctagtggagcgggagcggggttcttgtgtcataactatcgcctgcaactgccctaaccctggattacatcaagatctttgttgtcacctgtgcgctgagtataataaacgctgagatcagactctactggggctcctgtcgccatcctgtgaacgccaccgtcttcacccaccccgagcagccccaggcgaacctcacctgcggcctgcgtcggagggccaagaagtacctcacctggtacttcaacggcaccccctttgtggtttacaacagcttcgaccaggacggagttgccttgagagacgacctttccggtctcagctactccattcacaagaacaccaccctccacctcttccctccctacctgccgggaacctacgagtgcgtcaccggccgctgcacccacctcatccgcctgatcgtaaaccagacctttccgggaacacacctcttccccagaacaggaggtgagctcaggaaaccccctggggcccagggcggagacttaccttcgacccttgtggggttaggattttttatcgccgggttgctggctctcctgatcaaagcttccttgagatttgttctctccctttacttttatgaacagctcaacttctaataacgctaccttttctcaggaatcgggtagtaacttctcttctgaaatcgggctgggtgtgctgcttactctgttgatttttttccttatcatacttagccttctgtgcctcaggctcgccgcctgctgcgcacatatctacatctacagccggttgcttaactgctggggtcgccatccaagatgaacggggctcaggtgctatgtctgctggccctggtggcctgcagtgccgccgtcaattttgaggaacccgcttgcaatgtgactttcaagcctgaaggcgcacattgcaccactctggttaaatgtgtgacctctcatgacaaactgctcatcgcctacaaaaacaaaacaggcgagttcgcggtctatagcgtgtggcaacccggagaccataataactactcagtcaccgtcttcgagggtgcggagtctaagaaattcgattacacctttcccttcgaggagatgtgtgaagcggtcatgtacctgtccaaacagtacaagctgtggccccccacccccgaggcgtgtgtggaaaacactgggtctttctgctgtctctctctgacaatcactgtgcttgctctaatctgcacgctgctgtacatgaaattcaggcagaggcgaatctttatcgatgagaaaaaaatgccttgatcgctaacaccggctttctgtctgcagaatgaaagcaatcacctccctactaatcagcaccaccctccttgcgattgcccatgggttgacacgaatcgaagtgccagtggggtccaatgtcaccatggtgggccccgccggcaattcctccctgatgtgggaaaaatatgtccgtaatcaatgggatcattactgctctaatcgaatctgtatcaagcccagagccatctgcgacgggcaaaatctaactttgattgatgtgcaaatgacggatgctgggtactattacgggcagcggggagaaatgattaattactggcgaccccacaaggactacatgctgcatgtagtcaaggcagtccccactactaccacccccaccactaccactcccaccactcccactactaccacccccaccactactactagcactgctactaccgctgcccgcaaagctattacccgcaaaagcaccatgcttagcaccaagccccattctcactcccacgccggcgggcccaccggtgcggcctcagaaaccaccgagctttgcttctgccaatgcactaacgccagcgcccacgaactgttcgacctggagaatgaggatgatgaccagctgagctccgcttgcccggtcccgctgcccgcagagccggtcgccctgaagcagctcggtgatccatttaatgactctcctgtttatccctctcccgaatacccgcccgactctaccttccacatcacgggcaccaacgaccccaacctctccttctacctgatgctgctgctttgtatctctgtggtatcttccgcgctcatgttactgggcatgttctgctgcctcatctgccgcagaaagagaaagtctcgctctcagggccaaccactgatgcccttcccctaccccccagattttgcagataacaagatatgagcacgctgctgacactaaccgctttactcgcctgcgctctaacccttgtcgcttgcgaatccagataccacaatgtcacagttgtgacaggagaaaatgttacattcaactccacggccgacacccagtggtcatggagccaccacggtagctatttagacatctgcaatagctccacctcccctaacatgtcctttcccaagtaccactgcaatgccagcctgtttaccctcttcaacgcctccacctcggacaatggactctatgtaggctatgtgacacccggtgggcagggaaagactcatgcctacaacctgcaagttcgccacccctccaccaccgccaccacctctgccgcccctacccgcagcagcagcatcagcagcagcagattcctgactttaatcctagccagctcaacaaccaccgctgagaccacccaggccacctacagctccgcgcccgaaaccacccacacccaccacccagagacgaccgcggcctccagcgaccagatgtcggccaacatcaccgcctcgggtcttgaacttgcttcaacccccaccccaaaaccagtggatgcagccgacgtctccgccctcgtcaatgactgggcggggctgggaatgtggtggttcgccataggcatgatggcgctctgcctgcttctgctctggctcatctgctgcctcaaccgcaggcgggccagacccatctatagacccatcattgttctcaaccccgctgatgatgggatccatagattggatggtctgaaaaacctacttttctcttttacagtatgataaattgagacatgcctcgcattttcatgtacttgacacttctcccactttttctggggtgttctacgctggccgccgtctctcacctcgaggtagactgcctcacacccttcactgtctacctgatttacggattggtcaccctcactctcatctgcagcctaatcacagtagtcatcgccttcatccagtgcattgactacatctgtgtgcgcctcgcatacctgagacaccacccgcagtaccgagacaggaacattgcccaactcctaagactgctctaatcatgcataagactgtgatctgcctcctcatcctcctctccctgcccgctctcgtctcatgccagcccaccacaaaacctccacgaaaaagacatgcctcctgtcgcttgagccaactgtggaatattcccaaatgctacaatgaaaagagcgagctttccgaagcctggctatatgcggtcatgtgtgtccttgtcttctgcagcacaatctttgccctcatgatctacccccactttgatttgggatggaatgcggtcgatgccatgaattaccctacctttcccgcgcccgatatgattccactccgacaggttgtggtgcccgtcgccctcaatcaacgccccccatcccctacacccactgaggtcagctactttaatctaacaggcggagatgactgacactctagatctagaaatggacggcatcggcaccgagcagcgtctcctacagaggcgcaagcaggcggctgaacaagagcgcctcaatcaggagctccgagatctcattaacctgcaccagtgcaaaaaaggcatcttttgcctggtcaagcaggccgatgtcacctacgagaaaaccggtaacagccaccgcctcagctacaagctgcccacccaacgccagaagttggtgctcatggtgggtcagaatcccatcaccgtcacccagcactcggtggagaccgaggggtgtctgcactccccctgtcagggtccggaagacctctgcaccctggtaaagaccctgtgtggtcttagagatctaatcccctttaactaatc

SEQ ID NO: 87 - protein, 209 aa, Unknown
  Synthetic Construct
MAPRKKQPPPPPAYMLLEEEEDWDSQAEEVSDEDEEEEMMEDWEEDSLDEEASEAEEVADATPSPSAAAPSPAPPKSSDPSSSAITSAPPAPAPTRSRPNRRWDTTGTGVGKSKCPPAPPPQQEQQQQQRRQGYRSWRGHKNAIVACLQDCGGNISFARRFLLFHHGVAFPRNVLHYYRHLYSPYCGGGGDPEGAAAAAAAAPATAATT

SEQ ID NO: 88 - protein, 185 aa, Unknown
  Synthetic Construct
IKIFVVTCALSIINAEIRLYWGSCRHPVNATVFTHPEQPQANLTCGLRRRAKKYLTWYFNGTPFVVYNSFDQDGVALRDDLSGLSYSIHKNTTLHLFPPYLPGTYECVTGRCTHLIRLIVNQTFPGTHLFPRTGGELRKPPGAQGGDLPSTLVGLGFFIAGLLALLIKASLRFVLSLYFYEQLNF

SEQ ID NO: 89 - protein, 269 aa, Unknown
  Synthetic Construct
MSTLLTLTALLACALTLVACESRYHNVTVVTGENVTFNSTADTQWSWSHHGSYLDICNSSTSPNMSFPKYHCNASLFTLFNASTSDNGLYVGYVTPGGQGKTHAYNLQVRHPSTTATTSAAPTRSSSISSSRFLTLILASSTTTAETTQATYSSAPETTHTHHPETTAASSDQMSANITASGLELASTPTPKPVDAADVSALVNDWAGLGMWWFAIGMMALCLLLLWLICCLNRRRARPIYRPIIVLNPADDGIHRLDGLKNLLFSFTV

SEQ ID NO: 90 - protein, 128 aa, Unknown; identical to SEQ ID NO: 59
  Synthetic Construct

SEQ ID NO: 91 - DNA, 960 bp, Unknown
  Simian adenovirus 42.2
  CDS (6)..(546): E1a
  CDS (659)..(954): E1a
gaaaaatgagacatttcacctacgatggcggtctgctcaccggccagctggctgcctcggtcctggacgccctgatcgaggaggtattggccgacaattatcctcctccagctcattttgagccgcctactcttcacgaactgtatgatttggacgtggtggcacctagcgacccgaacgagcaggcggtttccagtttttttcctgactctatgctgttggccagccaggagggggtcgagctggagacccctcctccaattctcgtttcccctgagccgccgaccctgaccaggcagcccgatcgccgtgttggacctgcgactatgccccatctgctgcccgaggtgatcgatctcacctgtaacgagtctggttttccacccagcgaggatgaggacgaagagggtgagcagtttgtgttagattctgtggaggaacccgggcgcggttgcagatcttgtcaataccatcggaaaaatacaggagacccccaaattatgtgttccctgtgttatatgaagacgacctgtatgtttatttacagtaagtttgtgattggtgggtcggtgggctgtagtgtgggtaggtggtctgtggtttttttttttttaatatcagcttgggctaaaaaactgctatggtaatttttttaaaggtccggtgtctgaacctgagcaggaagctgaaccggagcctgagagtcgccccaggagaaggcctgcaattctaactagaccgagtgcacctgtagcgagggacctcagcagtgcagagaccaccgattccggtccttcctcatcccctccagagattcaccccgtggtgcctttgtgtcccctcaagcccgttgccgtgagagttagtgggcggagggccgccgtggagagcattgaggacttgcttaatgagacacaggaacctttggacttgagctgtaaacgccctaggcaataaacc

SEQ ID NO: 92 - protein, 279 aa, Unknown
  Synthetic Construct
MRHFTYDGGLLTGQLAASVLDALIEEVLADNYPPPAHFEPPTLHELYDLDVVAPSDPNEQAVSSFFPDSMLLASQEGVELETPPPILVSPEPPTLTRQPDRRVGPATMPHLLPEVIDLTCNESGFPPSEDEDEEGEQFVLDSVEEPGRGCRSCQYHRKNTGDPQIMCSLCYMKTTCMFIYSPVSEPEQEAEPEPESRPRRRPAILTRPSAPVARDLSSAETTDSGPSSSPPEIHPVVPLCPLKPVAVRVSGRRAAVESIEDLLNETQEPLDLSCKRPRQ

SEQ ID NO: 93 - DNA, 960 bp, Unknown
  Simian adenovirus 42.2
  CDS (9)..(349): 33K
  CDS (675)..(951): 33K
ttcccaggatggcacccagaaagaagcagccgccgccgccgccagcatacatgcttctggaggaagaggaggactgggacagtcaggcagaggaggtttcggacgaggacgaggaggaggaaatgatggaagactgggaggaggacagcctagacgaggaagcttcagaggccgaagaggtggcagacgcaacaccatcaccctcggccgcagccccctcgccggcgcccccgaaatcctccgaccccagcagcagcgctataacctccgctcctccggcgccggcgcccacccgcagcagacccaaccgtagatgggacactacaggaaccggggtcggtaagtccaagtgccccccagcgccgcccccgcaacaggagcaacagcagcagcagcggcgacagggctaccgctcgtggcgcggacacaagaacgccatagtcgcctgcttgcaagactgcgggggcaacatctccttcgcccgccgcttcctgctcttccaccacggggtggcttttccccgcaatgtcctgcattactaccgtcatctctacagcccctactgcggcggcggcggcgacccagagggagcggcggcagcagcagcagcagcgccagccacagcggcgaccacctaggaagacctccgcgggcaagacggcgggagccgggagacccgcggcggcggcggtagcggcggcggcgggcgcactgcgcctctcgcccaacgaacccctctcgacccgggagctcagacacaggatcttccccactctgtatgctatcttccagcagagcagaggccaggaacaggagctgaaaataaaaaacagatctctgcgctccctcacccgcagctgtctgtatcacaaaagcgaagatcagcttcggcgcacgctggaggacgcggaggcactcttcagcaaatactgcgcgctgactcttaaggactagccgcgc

SEQ ID NO: 94 - protein, 206 aa, Unknown; identical to SEQ ID NO: 63
  Synthetic Construct

SEQ ID NO: 95 - DNA, 37711 bp, Unknown
  Simian adenovirus 44
  repeat_region (1)..(106): ITR
  CDS (1606)..(2256): E1b\19K
  CDS (3621)..(4061): pIX
  misc_feature (4126)..(5750): complement (4126..5459,5738..5750)    IVa2
  misc_feature (5232)..(14239): complement (5232..8834,14231..14239)    pol
  misc_feature (8636)..(14239): complement (8636..10639,14231..14239)    pTP
  CDS (11114)..(12370): 52K
  CDS (12397)..(14166): pIIIa
  CDS (14281)..(16023): penton
  CDS (16029)..(16625): pVII
  CDS (16724)..(17815): V
  CDS (17844)..(18083): pX
  CDS (18190)..(18966): pVI
  CDS (19097)..(21982): hexon
  CDS (22015)..(22647): protease
  misc_feature (22773)..(24407): complement   DBP
  CDS (24445)..(26940): 100K
  CDS (27654)..(28334): pVIII
  CDS (28338)..(28652): E3\12.5K
  CDS (28657)..(29163): E3\CR1-alpha
  CDS (29350)..(29826): E3\gp19K
  CDS (29858)..(30766): E3\CR1-beta
  CDS (31596)..(31865): E3\RID\alpha
  CDS (31871)..(32269): E3\RID\beta
  misc_feature (34672)..(35829): complement (34672..34944,35647..35829)    E4\orf6/7
  misc_feature (34948)..(35829): complement   E4\orf6
  misc_feature (35732)..(36097): complement   E4\orf4
  misc_feature (36107)..(36451): complement   E4\orf3
  misc_feature (36451)..(36840): complement   E4\orf2
  misc_feature (36902)..(37285): complement   E4\orf1
  repeat_region (37606)..(37711): ITR    complement
catcatcaataatataccttattttggattgaagccaatatgataatgaggtgggcggagtggggcggagttgggaggcgcggggcggggcggcggcgcggggcgggccgggaggtgtggcggaagttgagtttgtaagtgtggcggatgagacttgctagcgccggatgtggtaaaagtgacgtttttggagtgcgacaacgcccacgggaagtgacatttttcccgcggtttttaccggatgtcgtagtgaatttgggcgttaccaagtaagatttggccattttcgcgggaaaactgaaatggggaagtgaaatctgattaatttcgcgttagtcataccgcgtaatatttgccgagggccgagggactttgaccgattacgtggaggaatcgcccaggtgttttttgaggtgaatttccgcgttccgggtcaaagtctccgttttattattatagtcagctgacgcggagtgtatttatacccgctgatctcgtcaagaggccactcttgagtgccagcgagtagagttttctcctctgccgcttcgctccgctccgacaccgggggaaaaatgagacatttcacctacgatggcggtctgctcaccggccagctggctgcctcggtcctggacgtcctgatcgaggaggtattggccgacaattatcctcctccagctcattttgagccgcctactcttcacgaactgtatgatttggacgtggtggcacctagcgacccgaacgagcaggcggtttccagtttttttcctgactctatgctgttggccagccaggagggggtcgagctggagacccctcctccaattctcgtttcccctgagccgccgaccctgaccaggcagcccgatcgccgtgttggacctgcgactatgccccatctgctgcccgaggtgatcgatctcacctgtaacgagtctggttttccacccagcgaggatgaggacgaagagggtgagcagtttgtgttagattctgtggaggaacccgggcgcggttgcagatcttgtcaataccatcggaaaaatacaggagacccccaaattatgtgttccctgtgttatatgaagacgacctgtatgtttatttacagtaagtttgtgattggtgggtcggtgggctgtagtgtgggtaggtggtctgtggtttttttttttaatatcagcttgggctaaaaaactgctatggtaattttttaaaggtccggtgtctgaacctgagcaggaagctgaaccggagcctgagagtcgccccaggagaaggcctgcaattctaactagaccgagtgcacctgtagcgagggacctcagcagtgcagagaccaccgattccggtccttcctcatcccctccagagattcaccccgtggtgcctttgtgtcccctcaagcccgttgccgtgagagttagtgggcggagggccgccgtggagagcattgaggacttgcttaatgagacacaggaacctttggacttgagttgtaaacgccctaggcaataaacctgcttacctggactgaatgagttgacgcctatgtttgcttttgaatgacttaatgtgtatataataaagagtgagataatgtttaattgcatggtgtgtttgattggggcggggtttgttgggtatataagcttccctgggctaaacttggttacacttgacctcatggaggcctgggagtgtttagagagctttgccgaagtgcgtgctttgctggaagagagctctaataatacctctgggtggtggaggtatttttggggctctccccaggctaagttagtttgtagaatcaaggaggattacaagtgggaatttgaacagcttttgaaatcctgtggtgagctcttggattctttgaatctgggccaccaggctcttttccaggacaagatcatcaggactttggatttttccacaccggggcgcattgctgccggggttgcttttctagcttttttgaaggataaatggagcgaagagacccacttgagttcgggatacgtcctggattttctggccatacaactgtggagagcatggatcaggcacaagaacagaatgcaactgttgtcttccgtccgtccgttgctgattcagccggaggagcagcagaccgggccggaggaccgggctcgtccggaaccagaggagagggcgcccgcggcggcgccggagaggagcgcgtggaacctgggagccggcctgaacggccatccacatcgggagtgaatgttggacaggtggcggatctctttccagaactgcgacgaatcttgactattagggaggatggacaatttgttaagggccttaagagggagcggggggcttctgaacataacgaggaggccagtaatttagcttttagtctgatgaccagacaccgtcccgagtgcattacttttcagcagattaaagataattgtgccaatgagttagatctgctgggtcagaagtacagcatagagcagttgaccacttactggttgcagccgggtgatgatctggaggaagctattagggtgtatgccaaggtggccctgaggcccgattgcaagtacaagctcaaggggctggtgaatatcaggaattgttgctacgtttctgggaacggggcggaggtggagatagagaccgatgacagggtggcctttaggtgcagcatgatgaatatgtggcctggggtgctgggcatggacggggtggtgattatgaatgtgaggttcacggggcccaattttaatggcacggtgttcctgggcaacaccaacctggtgctgcacggggtgagcttctatggctttaacaacacctgtgtggaggcctggaccgatgtgaaggtccgtggctgtgccttctacggatgttggaaggcggtagtgtgtcgccccaagagcaggagttccattaaaaaatgcttgtttgagaggtgcaccctgggggtgctggcggagggcaactgtcgggtgcgccacaatgtggcctccgaatgcggttgcttcatgctagtgaagagcgtggcggtcatcaagcataacatggtgtgcggcaacagcgaggacaaggcctcgcagatgctgacctgctcggatggcaactgccacttactcaagaccatccatataaccagccacagccgcaaggcctggcccgtgttcgagcacaacgtgttgacccgctgctccttgcatctgggcaacaggaggggtgtgttcctgccctatcaatgcaacttgagccacaccaaggtcttgctagagcccgaaagcatgtccaaggtgaacctgaacggggtgtttgacatgaccctgaagatatggaaggtgctgaggtacgacgagaccaggtcccggtgcaggccctgcgagtgcgggggcaagcatatgaggaaccagcctgtgatgctggatgtgaccgaggagctgaggcctgaccacttggttctggcctgcaccagggccgagtttggttctagcgatgaagacacagactgaggtgggtgagtgggcgtggtctgggggtgggaaacaatatataagttgggggtcttagggtctctgtgtctgttttgcagagggaccgccggcgccatgagcgggagcagtagcagcaacgccttggatggcagcatcgtgagcccttatttgacgacgcgcatgccccactgggccggggtgcgtcagaatgtgatgggctccagcatcgacggacgacccgtgctgcccgcaaattccgccacgctgacctacgcgaccgtcgcggggaccccgttggacgccaccgccgccgccgccgccaccgccgccgcctcggccgtgcgcagcctggccacggactttgcattcttgggacccttggccaccggggcggccgcccgtgccgccgttcgcgatgacaagctgaccgccctgctggcgcagttggatgcgcttacccgggaactgggtgacctttcgcagcaggtcgtggccctgcgccagcaggtctccgccctgcaggctagcgggaatgcttctcctgcaaatgccgtttaagataaataaaaccagactctgtttggattaaagaaaagtagcaagtgcattgctctctttatttcataattttccgcgcgcgataggcccgagtccagcgttctcggtcgttgagggtgcggtgtatcttctccaggacgtggtagaggtggctctggacgttgagatacatgggcatgagcccgtcccgggggtggaggtagcaccactgcagagcttcatgctccggggtggtgttgtagatgatccagtcgtagcaggagcgctgggcatggtgcctaaaaatgtccttaagcagcaggccgatggccagggggaggcccttggtgtaagtgtttacaaaacggttgagttgggaagggtgcatgcggggtgagatgatgtgcatcttagattgtatttttagattggcgatgtttcctcccagatcccttctgggattcatgttgtggaggaccaccagcacagtatatccggtgcacttgggaaatttgtcatgcagcttagagggaaatgcgtggaagaacttggagacgcccttgtggcctcccagattctccatgcattcgtccatgatgatggcaatgggcccgcgggaggcggcctgggcaaagatgtttctggggtcactgacatcgtagttgtgttccagggtgagatcgtcataggccatttttataaagcgcgggcggagggtgcccgactgggggatgatggttccctcgggccccggggcgtagttgccttcgcagatctgcatttcccaggccttaatttctgaggggggaatcatgtccacttgcggggcgatgaagaaaacggtttccggagccggggagattaactgggatgagagcaggtttctcagcagctgtgactttccacagccggtggggccataaataacacctataaccggctgcagctggtagttgagcgagctgcagctgccgtcgtcccggaggaggggggccacctcattgagcatgtcccggacgcgcttgttctcctcgaccaggtccgccagaaggcgctcgccgcccagggacagcagctcttgcaaggaagcaaagtttttcagcggcttgaggccgtccgccgtgggcatgtttttcagggtctggccgagcagctccaggcggtcccagagctcggtgacgtgctctacggcatctctatccagcatatctcctcgtttcgcgggttggggcggctttcgctgtagggcaccaggcgatggtcgtccagcgcggccagagtcatgtccttccatgggcgcagggtcctcgtcagggtggtctgggtcacggtgaaggggtgcgccccgggctgggcgctggccagggtgcgcttgagactggtcctgctggtgctgaagcgctgccggtcttcgccctgcgcgtcggccaggtagcatttgaccatggtgtcgtagtccagcccctccgcggcgtgtcccttggcgcgcagcttgcccttggaggtggcgccgcacgcggggcactgcaggctcttgagcgcgtagagcttgggggcgaggaagaccgattcgggggagtaggcgtccgcgccgcaggccccgcacacggtctcgcactccaccagccaggtgagctcggggcgctcggggtcaaaaaccaggtttcccccatgctttttgatgcgtttcttacctcgggtctccatgaggcggtgtccccgctcggtgacgaagaggctgtccgtgtctccgtagaccgacttgaggggtctgtcctccaggggggtccctcggtcctcttcgtagagaaactcggaccactctgagacgaaggcccgcgtccaggccaggacgaaggaggctaggtgggaggggtaccggtcgttgtccactagggggtccactttttccaaggtgtgaagacacatgtcgccctcctcggcgtccaggaaggtgattggcttgtaggtgtaggccacgtgacccggggttccggacgggggggtataaaagggggtgggggcgcgctcgtcctcactctcttccgcatcgctgtctgcgagggccagctgctggggtgagtattccctctcgaaggcgggcatgacctcagcgctgaggctgtcagtttctaaaaacgaggaggatttgatgttcacctgtcccgagctgatgcctttgagggtgcctgcgtccatctggtcagaaaacacgatctttttattgtccagcttggtggcgaacgacccgtagagggcgttggagagcagcttggcgatggagcgcagggtctgatttttgtccctgtcggcgcgctccttggccgcgatgttgagctgcacgtactcgcgcgcgacgcagcgccactcggggaagacggtggtgcgctcgtcgggcaccaggcgcacgcgccagccgcggttgtgcagggtgacgaggtccacgctggttgcgacctcgccgcgcaggcgctcgttggtccagcagaggcgcccgcccttgcgcgagcagaaggggggcagggggtcgagttgggtttcgtccggggggtccgcgtccaccgtgaagaccccggggcgcaggcgcgcgtcgaagtagtcgatcttgcatccttgcaagtccagcgcctgctgccagtcgcgggcggcgagcgcgcgctcgtaggggttgagcggcgggccccagggcatggggtgggtgagcgcggaggcgtacatgccgcagatgtcgtagacgtagaggggctcccggaggatgcccaggtaggtggggtagcagcggccgccgcggatgctggcgcgcacgtagtcgtagagctcgtgcgagggggcgaggaggtcggggcccaggttggtgcgggcggggcgctccgcgcggaagacgatctgcctgaagatggcatgcgagttggaagagatggtggggcgctggaagacgttgaagctggcgtcctgcaggccgacggcgtcgcgcacgaaggaggcgtaggactcgcgcagcttgtgcaccagctcggcggtgacctgcacgtcgagcgcgcagtagtcgagggtctcgcggatgatgtcatacttagcctgccccttctttttccacagctcgcggttgaggacgaactcttcgcggtctttccagtactcttggatcgggaaaccgtccggctccgaacggtaagagcccagcatgtagaactggttgacggcctggtaggcgcagcagcccttctccacggggagggcgtaggcctgcgcggccttgcggagcgaggtgtgggtcagggcgaaggtgtccctgaccatgaccttgaggtactggtgtttgaagtcggagtcgtcgcagccgccccgctcccagagcgagaagtcggtgcgctttttggagcgggggttgggcagcgcgaaggtgacatcgttgtagaggatcttgcccgcgcgaggcatgaagttgcgggtgatgcggaagggccccggcacttccgagcggttgttgatgacctgggcggcgagcacgatctcgtcgaagccgttgatgttgtggcccacgatgtagagttccaggaagcggggccggcccttgacgctgggcagcttctttagctcttcgtaggtgagctcctcgggcgaggcgaggccgtgctcggccagggcccagtccgccagatgcgggttgtccgcgaggaaggaccgccagaggtcgcgggccaggagggtttgcaggcggtccctgaaagtcctgaactggcggcccacggccatcttttcgggggtgacgcagtagaaggtgagggggtcttgctgccaggagtcccagtcgagctccagggcgaggtcgcgcgcggcggcgaccaggcgctcgtcgcccccgaatttcatgaccagcatgaagggcacgagctgctttccgaaggcgcccatccaagtgtaggtctctacatcgtaggtgacaaagagacgctccgtgcgaggatgcgagccgatcgggaagaactggatctcccgccaccagttggaggagtggctgttgatgtggtggaagtagaagtcccgtcggcgggccgagcactcgtgctggcttttgtaaaagcgagcgcagtactggcagcgctgcacgggctgtacctcttgcacgagatgcacctgccgaccgcggacgaggaagctgagtgggaatctgagccccccgcatggctcgcggcctggctggtgctcttctactttggatgcgtggccgtcaccgtctggctcctcgaggggtgttacggtggagcggaccaccacgccgcgcgagccgcaggtccagatatcggcgcgcggcggtcggagtttgatgacgacatcgcgcagctgggagctgtccatggtctggagctcccgcggcggcggcaggtcagccgggagttcttgcaggtttacctcgcagagacgggccagggcgcggggcaggtccaggtggtacttgaactcgagaggggtgttggtggcggcgtcgatggcttgcaggaggccgcagccccggggcgcgacgacggtgccccgcggggcggtgaagctgccgccgccgctcctgctgttgccgccggtggcagggcttagaagcggtgccgcggtcgggcccccggaggtagggggggctccggtcccgcgggcaggggcggcagcggcacgtcggcgccgcgcgcgggcaggagctggtgctgcgcccggaggttgctggcgaaggcgacgacgcggcggttgatctcctggatctggcgcctctgcgtgaagacgacgggtccggtgagcttgaacctgaaagagagttcgacagaatcaatctcggtgtcattgaccgcgacctggcgcaggatctcctgcacgtcgcccgagttgtcttggtaggcgatctctgccatgaactgttcgatctcttcctcctggaggtctccgcgtccggcgcgctccacggtggccgccaggtcgttggagatgcgcgccatgagctgcgagaaggcgttgagtccgccctcgttccagacccggctgtagaccacgccgccctggtcgtcgcgggcgcgcatgaccacctgcgcgaggttgagttccacgtggcgcgcaaagacggcgtagttgcgcaggcgctggaagaggtagttgagggtggtggcggtgtgctcggccacgaagaagtacatgacccagcggcgcaacgtggattcgttgatgtcccccaaggcctccagtcgctccatggcctcgtagaagtccacggcgaagttgaaaaactgggagttgcgcgccgacacggtcaactcctcctccagaagacggatgagctcggcgacggtgtcgcgcacctcgcgctcgaaggctatggggatctcttcctccgccagcatcaccacctcttcctcttcctcttcctctggcacttccatgatggcttcttcttcctcctcttcggggggcggcggcggcggtgggggagggggcgctcggcgccggcggcggcgcaccgggaggcggtccacgaagcgctcgatcatctccccgcggcggcgacgcatggtctcggtgacggcgcggccgttctctcgggggcgcagctggaagacgccgccggtcatctggtgctggggcgggtggccgtggggcagcgagaccgcgctgacgatgcatctcaacaattgctgcgtaggtacgccgccgagggacctgagggagtccagatccaccggatccgaaaacctttcgaggaaggcatctaaccagtcgcagtcgcaaggtaggctgagcaccgtggcgggcggcggggggtggggggagtgtctggcggaggtgctgctgatgatgtaattgaagtaggcggtcttgacacggcggatggtcgacaggagcaccatatccttgggcccggcctgctggatgcggaggcggtcggccatgccccaggcttcgttctggcatctgcgcaggtctttgtagtagtcttgcatgagcctttccaccggcacctcttctccttcttcttctgacatctctgctgcatctgcggccctggggcggcggcgtgcgcccctgccccccatgcgcgtcaccccgaaccccctgagcggctggagcagggccaggtcggcgacgacgcgctcggccaggatggcctgctggacctgcgtgagggtggtttggaagtcatccaagtccacgaagcggtggtaggcgcccgtgttgatggtgtaggtgcagttggccatgacggaccagttgacggtctggtggcccggttgcgtcatctcggtgtacctgaggcgcgagtaggcgcgcgagtcgaagatgtagtcgttgcaagtccgcaccaggtactggtagcccaccaggaaatgcggcggcggctggcggtagaggggccagcgcagggtggcgggggctccgggggccaggtcttccagcatgaggcggtggtattcgtagatgtacctggacatccaggtgatgcccgcggcggtggtggaggcgcgcgggaagtcgcgcacccggttccagatgttgcgcagcggcagaaagtgctccatggtaggcgtgctctggccggtcaggcgcgcgcagtcgttgatactctagaccggggaaaacgaaagccggtcagcgggcactcttccgtggtctggtggataaattcgcaagggtatcatggcggagggcctcggttcgagccccgggcccgggccggacggtccgccatgatccacgcggttaccgcccgcgtgtcgaacccaggtggcgacgtcagacaacggtggagtgttccttttgggttttttccaaatttttttggccgggtgccgacgccgccgcgtaagagactagagtgcaaaagcgaaagcagtaagtggctcgctccctgtagcccggaggatccttgctaagggttgcgttgcggcgaaccccggttcgagtctggctctcgcgggccgctcgggccggccggaaccgcggctaaggcgggattggcctccccctcattaaagaccccgcttgcggattcctccggacacaggggacgagcccctttttacttttgcttttctcagatgcatccggtgctgcggcagatgcgccccccgccccagcagcagcagcaacatcagcaagagcgtcaccagcagcagcgggagtcatgcagggccccctcgcccacgctcggcggtccggcgacctcggcgtccgcggccgtgtctggagccggcggcggggggctggcggacgacccggaggagcccccgcggcgcagggccagacagtacctggacctggaggagggcgagggcctggcgcggctgggggcgccgtcccccgagcgccacccgcgggtgcagctgaagcgcgactcgcgcgaggcgtacgtgcctcggcagaacctgttcagggaccgcgcgggcgaggagcccgaggagatgcgggaccgcaggttcgccgcggggcgggagttgcggcaggggctgaaccgggagcggctgctgcgcgaggaggactttgagcccgacgcgcggacggggatcagccccgcgcgcgcgcacgtggcggccgccgacctggtgacggcgtacgagcagacggtgaaccaggagatcaacttccaaaaaagcttcaacaaccacgtgcgcacgctggtggcgcgcgaggaggtgaccatcggcctgatgcacctgtgggactttgtgtgcgcgctggagcagaaccccaacagcaagcctctgacggcgcagctgttcctgatagtgcagcacagcagggacaacgaggcgttcagggacgcgctgctgaacatcaccgagcccgagggtcggtggctcctggacctgattaacattttgcagagcatagtggtgcaggagcgcagcctgagcctggccgacaaggtggcggccatcaattactcgatgctcagtctgggcaagttttacgcgcgcaagatctaccagacgccgtacgtgcccatagacaaggaggtgaaaatcgacggcttctacatgcgcatggcgctgaaggtgctgaccctgagcgacgacctgggcgtgtaccgcaacgagcgcatccacaaggccgtgagcgtgagccggcggcgcgagctgagcgaccgcgagctgatgcacagcctgcagcgggcgctggcgggggccggcagcggcgacagggaggccgagtcctacttcgaggcgggggcggacctgcgctgggtgcccagccggagggccctggaggccgcgggggcccgccgcgaggactatgcagacgaggaggaggaggatgacgaggagtacgagctagaggagggcgagtacctggactaaaccgcaggtggtgtttttggtagatgcaagacccgaacgtggtggacccggcgctgcgggcggctctgcagagccagccgtccggccttaactctacagacgactggcgacaggtcatggaccgcatcatgtcgctgacggcgcgcaatccggacgcgttccggcagcagccgcaggccaacaggctctccgccatcttggaggcggtggtgcctgcgcgcgcgaaccccacgcacgagaaggtgctggccatagtaaacgcgctggccgagaacagggccatccgcccggacgaggccgggctggtgtacgacgcgctgctgcagcgcgtggcccgctacaacagcggcaacgtgcagaccaacctggaccggctggtgggggacgtgcgcgaggcggtggcgcagcgggagcgcgcggagcggcagggcaacctcggctccatggtggcgctgaacgccttcctgagcacgcagccggccaacgtgccgcgggggcaggaggactacaccaactttgtaagcgcgctgcggctgatggtgaccgagaccccccagagcgaggtgtaccagtcggggccggactacttcttccagaccagcagacagggcctgcagacggtgaacctgagccaggctttcaagaacctgcgggggctgtggggcgtgaaggcgcccaccggggaccgggcgacggtgtccagcctgctgacgcccaactcgcgcctgctgctgctgctgatcgcgccgttcacggacagcggcagcgtgtcccgggagacctacctcgggcacctgctgaccctgtaccgcgaggccatcgggcagacccaggtggacgagcacaccttccaggagatcaccagcgtgagccgcgcgctggggcaggaggacacgggcagcctggaggcgaccctgaactacctgctgaccaaccggcggcagaagatcccctcgctgcatagtttgaccaccgaggaggagcgcatcctgcgctacgtgcagcagagcgtgagcctgaacctgatgcgcgacggggtgacgcccagcgtggcgctggacatgaccgcgcgcaacatggaaccgggcatgtacgccgcgcaccggccttacatcaaccgcctgatggactacttgcatcgcgcggcggccgtgaaccccgagtacttcaccaacgccatcctaaacccgcactggctcccgccgcccgggttctacagcggggggttcgaggtccccgaggccaacgacggcttcctgtgggacgacatggacgacagcgtgttctccccgcggccgcaggcgctggcggaggcgtcgctgctccgcctccccaagaaggaagagagccgccggcccagcagcgcggcggcctctctgtccgagctgggggcggcggccgcgcggcccgggtccctggggggcagcccctttcccagcctggtggggtctctgcagagcgggcgcaccacccggccccggctgctgggcgaggacgagtacctgaacaactccctgatgcagccggtgcgggagaaaaacctgccccccgccttccccaacaacgggatagagagcctggtagacaagatgagcagatggaagacctatgcgcaggagcacagggactcgcccgtgctccgtccgcccacgcggcgccagcgccacgaccggcagcgggggctggtgtgggatgacgaggactccgcggacgatagcagcgtgctggacctgggggggagcggcggcaacccgttcgcgcacctgcgcccccgcctggggaggatgtttcaataaaaaaaaaaaaaaaaatcaagcatgatgcaaggttttttaagcggataaataaaaaactcaccaaggccatggcgaccgagcgttgttggtttcttgttgtgttcccttagtatgcggcgcgcggcgatgtaccacgagggacctcctccctcttatgagagcgtggtgggcgcggcggcggcctctccctttgcgtcgcagctggagccgccgtacgtgcctccgcggtacctgcggcctacggggggaagaaacagcatccgttactcggagctggcgcccctgtacgacaccacccgggtgtacctggtggacaacaagtcggcggacgtggcctccctgaactaccagaacgaccacagcaattttttgaccacggtcatccagaacaatgactacaccccgagcgaggccagcacccagaccatcaatctggatgaccggtcgcactggggcggcgacctgaaaaccatcctgcacaccaacatgcccaacgtgaacgagttcatgttcaccaataagttcaaggcgcgggtgatggtgtcgcgctcgcacaccaaggacgaccgggtggagctgaagtacgagtgggtagagttcgagctgcccgagggcaactactcggagaccatgaccatagacctgatgaacaacgcgatcgtggagcactatctgaaagtgggcaggcagaacggggtcctggagagcgacatcggggtcaagttcgacaccaggaacttccgcctggggctggacccggtcaccgggctggttatgcccggggtctacaccaacgaggccttccaccccgacatcatcctgctgcccggctgcggggtggacttcacctacagccgcctgagcaacctgctgggcatccgcaagcggcagcccttccaggagggcttcaggatcacctacgaggacctggaggggggcaacatccccgcgctcctggatgtggaggcctaccaggatagcttgaaggaagaagaggcgggagagggcagcggcggtggcgccggtcaggaggagggcggggcctcctctgaggcctctgcggacccagccgctgccgccgaggcggaggcggccgaccccgcgatggtggtagaggaagagaaggatatgaacgacgaggcggtgcgcggcgacacctttgccactcggggggaggagaagaaagcggaggccgaggccgcggcagaggaggcggcagcagcggcggcggcagtagaggcggcggccgaggcggagaagccccccaaggagcccgtgattaagcccctgaccgaagatagcaagaagcgcagttacaacgtgctcaaggacagcaccaacaccgagtaccgcagctggtacctggcctacaactacggcgacccggcgacgggggtgcgctcctggaccctgctgtgtacgccggacgtgacctgcggctcggagcaggtgtactggtcgctgcccgacatgatgcaagaccccgtgaccttccgctccacgcggcaggtcagcaacttcccggtggtgggcgccgagctgctgcccgtgcactccaagagcttctacaacgaccaggccgtctactcccagctcatccgccagttcacctctctgacccacgtgttcaatcgctttcctgagaaccagattctggcgcgcccgcccgcccccaccatcaccaccgtcagtgaaaacgttcctgctctcacagatcacgggacgctaccgctgcgcaacagcatcggaggagtccagcgagtgaccgtaactgacgccagacgccgcacctgcccctacgtttacaaggccctgggcatagtctcgccgcgcgtcctttccagccgcactttttaagcatgtccatcctcatctcgcccagcaataacaccggctggggcctgctgcgcgcgcccagcaagatgttcggaggggcgaggaagcgctccgaccagcaccccgtgcgcgtgcgcgggcactaccgcgctccctggggcgcgcacaaacgcgggcgcaccggcaccgcggggcgcaccaccgtggacgaagccatcgactcggtggtggagcaggcgcgcaactacacgcccgcggtctccaccgtggacgcggctatcgagagcgtggtgcgaggcgcgcggcggtacgccaaggcgaagagccgccggaggcgcgtggcccgccgccaccgccgccgacccgggagcgccgccaagcgcgccgccgccgccttgctccgtcgggccagacgcacgggccgccgtgccgccatgagggccgcgcgccgcctggccgccggcatcaccaccgtggccccccgcgccagaagacgcgcggccgccgccgccgccgcggccatcagcgacctggccaccaggcgccggggcaacgtgtactgggtgcgcgactcggtgagcggcacgcgcgtgcccgtgcgcttccgccccccgcggacttgagaggagaggacaggaaaaagcaacaacatcaacaacaccaccactgagtctcctgctgttgtgtgtatcccagcggcgcgcgcgcacacggcgacatgtccaagcgcaaaatcaaagaagagatgctccaggtcgtcgcgccggagatctatgggcccccgaagaaggaagagcaggatttcaagccccgcaagataaagcgggtcaaaaagaaaaagaaagatgacgatgatggcgaggtggagtttctgcgcgccacggcgcccaggcgcccgctgcagtggaagggtcggcgcgtaaagcgcgttctgcgccccggcaccgcggtggtcttcacgcccggcgagcgctccacccgcactttcaagcgcgtctatgacgaggtgtacggcgacgaagacctgctggagcaggccaacgatcgctccggagagtttgcttacgggaagcggcaccgggcgatggagaaggacgaggtgctggcgctgccgctggaccggggcaaccccacccccagcctgaagcccgtgaccctgcagcaggtgctaccggccagcgcgccctccgagatgaagcggggcctgaagcgcgagggcggcgacctggcgcccaccgtgcagctaatggtgcccaagcggcagaggctggaggacgtgctggagaaaatgaaagtagaccccggcctgcagccggacatcagggtccgccccatcaagcaggtggcgccgggcctcggcgtgcagaccgtggacgtggtcatccccaccggcgcctcctcttccagcgccgccgccgccgccactagcaccgcggacatggagacgcagactagccccgccgccacctcctcggcggaggtacagacggacccctggttgccgccgccggcgaccgccccctcgcgcgcacgccgcgggcgcaggaagtacggcgccgccagcgcgctcatgcccgagtacgccttgcatccttccatcgcgcccacccccggctaccgaggctacagttaccgcccgcgaagagccaagggctccacccgccgcagccgccgcgccgccacctctacccgccgccgcagtcgccgccgccgccggcagcccgcgctggctccgatctccgtgaaaagagtggcgcgcaacgggaacaccttggtgctgcccagggcgcgctaccaccccagcatcgtttaaaaagcctgttgtggttcttgcagatatggccctcacttgccgcctccgtttcccggtgccgggataccgaggaagatcgcgccgcaggaggggtatggccggacgcggcctgagcggaggcagtcgccgtgcgcaccggcggcgacgcgccaccagccgacgcatgcgcggcggagtgctgcctctgctgatccccctgatcgccgcggcgatcggcgccgtgcccgggatcgcctccgtggccttgcaggcgtcccagaggcgttgacacagacttcttgcaagcttgcaaaaatatggaaaaatccccccaataaaaaagtctagactctcacgctcgcttggtcctgtgactattttgtagaaaaaagatggaagacatcaactttgcgtcgctggccccgcgtcacggctcgcgcccgttcctgggacactggaacgatatcggcaccagcaacatgagcggtggcgccttcagttggggctctctgtggagcggcattaaaaatatcggttctgccgttaagaattacggcaccaaggcctggaacagcagcacgggccagatgttgagagacaagttgaaagagcagaacttccagcagaaggtggtggagggtctggcctccggcatcaacggggtggtggacctggccaatcaggccgtgcaaaataagatcaacagcagactggacccccggccgccggtggaggagctgccgccggcgctggagacggtgtcccccgatgggcggggcgaaaagcgcccgcggcccgacagggaagagaccactctggtcacgcacaccgatgagccgcccccctacgaggaagccctgaagcaaggcttgcccaccactcggcccatcgcgcccatggccaccggggtggtgggccgccacacccccgccacgctggacctgcctcctcctcctgtttcttcttcggccgccgatgcgcagcagcagaaggcggcgctgcccggtccgcccgcggccgccccccgtcccaccgccagtcgagcgcccctgcgtcgcgcggccagcggcccccgcggggtcgcgaggcacagcagcggcaactggcagaacacgctgaacagcatcgtgggtctgggggtgcagtccgtgaagcgccgccgatgctactgaatagcttagctaacggtgttgtatgtgtgtatgcgtcctatgtcaccgccagaggagctgctgagtcgccgccgttcgcgcgcccaccgccactaccaccgccggtaccactccagcgcccctcaagatggcgaccccatcgatgatgccgcagtggtcgtacatgcacatctcgggccaggacgcctcggagtacctgagccccgggctggtgcagttcgcccgcgccaccgacagctacttcagcctgagtaacaagtttaggaaccccacggtggcgcccacgcacgatgtgaccaccgaccggtcccagcgcctgacgctgcggttcatccccgtggaccgcgaggacaccgcgtactcttacaaggcgcggttcaccctggccgtgggcgacaaccgcgtgctggacatggcctccacctactttgacatccgcggcgtgctggacaggggccccaccttcaagccctactccggcaccgcctacaactccctggcccccaagggcgcccccaactcctgcgagtgggagcaagtggagccagctgaagaggcagcagaaaatgaagatgaagaagaagaagaggatgttgttgatcctcaggaacaggagcccactactaaaacacatgtatatgctcaagctcccctttctggcgagaaaattaccaaagatggtctgcaaataggaactgaggctacggcagcaggaggcactaaagacttatttgcagaccctacattccagccagaaccccaagttggcgaatctcagtggaatgaggcggatgctacagcagctggaggtagagtgctcaaaaagaccactcccatgaaaccttgctatggctcatatgcccgccccacaaatgccaatgggggccaaggtgtgctaaaggcaaatgcccagggagtgctcgagtctcaggttgagatgcagttcttttccacttctacaaatgccacaaacgagcaaaacaacatccagcccaaattggtgctgtacagcgaggatgtgcatatggagaccccagacacacacatctcctacaagcctacaaaaagcgatgataattcaaaagtcatgctgggtcagcagtccatgcccaacaggccaaattacatcgccttcagagacaactttatcgggctcatgtattataacagcactggcaacatgggggtgctggcaggtcaggcctcacagttgaatgcagtggtggacctgcaagacagaaacacagaactgtcctaccagctcttgcttgattccatgggagacagaaccagatacttttccatgtggaatcaggccgtggacagttatgacccagatgtcagaattattgaaaatcatggaaccgaagatgagctgcccaactattgtttccctctgggaggcatagggataactgacacttaccaggccattaagactaatggcaatggggcaggagatcaagccaccacgtggcagaaagactcacaatttgcagaccgcaacgaaataggggtgggaaacaacttcgccatggagatcaacctcagtgccaacctgtggaggaacttcctctactccaacgtggccctgtacctgccagacaagcttaagtacaacccctccaacgtggaaatctctgacaaccccaacacctacgactacatgaacaagcgagtggtggccccggggctggtggactgctacatcaacctgggcgcgcgctggtccctggactacatggacaacgtcaaccccttcaaccaccaccgcaatgcgggcctgcgctaccgctccatgcttctgggcaacgggcgctacgtgcccttccacatccaggtgccccagaagttctttgccatcaagaacctcctcctcctgccgggctcctacacctacgagtggaacttcaggaaggatgtcaacatggtcctgcagagctctctgggcaacgacctcagggtcgacggggccagcatcaagttcgagagcatctgcctctacgccaccttcttccccatggcccacaacacggcctccacgctcgaggccatgctcaggaacgacaccaacgaccagtccttcaacgactacctctccgccgccaacatgctctaccccatccccgccaacgccaccaacgtccccatctccatcccctcgcgcaactgggcggccttccgcggctgggccttcacccgccttaagaccaaggagaccccctccctgggctcgggtttcgacccctactacacctactcgggctccataccctacctggacggaaccttctacctcaaccacactttcaagaaggtctcggtcaccttcgactcctcggtcagctggccgggcaacgaccgcctgctcacccccaacgagttcgagatcaagcgctcggtcgacggggagggctacaacgtagcccagtgcaacatgaccaaggactggttcctcatccagatgctggccaactacaacatcggctatcagggcttctacatcccagagagctacaaggacaggatgtactccttctttaggaacttccagcccatgagccggcaggtggtggacgaaaccaagtacaaggactaccagcaggtgggcatcatccaccagcacaacaactcgggcttcgtgggctacctcgcccccaccatgcgcgagggacaggcctaccccgccaacttcccctacccgctcattggcaagaccgcggtcgacagcatcacccagaaaaagttcctctgcgaccgcaccctctggcgcatccccttctccagcaacttcatgtccatgggtgcgctcacggacctgggccagaacctgctctatgccaactccgcccacgcgctcgacatgaccttcgaggtcgaccccatggacgagcccacccttctctatgttctgttcgaagtctttgacgtggttcgggtccaccagccgcaccgcggcgtcatcgagaccgtgtacctgcgcacgcccttctcggccggcaacgccaccacctaaagaagcaagccgccaccgccaccacctgcatgtcgtcgggttccaccgagcaggagctcaaggccatcgtcagagacctgggatgcgggccctattttttgggcaccttcgacaaacgcttcccgggcttcgtcgccccgcacaagctggcctgcgccatcgtcaacacggccggccgcgagaccgggggcgtgcactggctggccttcgcctggaacccgcgctccaaaacatgctacctctttgaccccttcggattctcggaccagcggctcaagcagatctaccagttcgagtacgagggcctgctgcgccgcagcgccatcgcctcctcgcccgaccgctgcgtcaccctcgagaagtccacccagaccgtgcaggggcccgactcggccgcctgcggtctcttctgctgcatgttcctgcatgcctttgtgcactggccccagagtcccatggaccgcaaccccaccatgaacttgctgacggggatccccaactccatgctccagagcccccaggccgcgcccaccctgcgccgcaaccaggagcggctctacagcttcctggagcgccactcgccctacttccgccgccacagcgcgcagatcaggggggccacctctttctgccgcatgcaagagatgcaagggaaaatgcaatgatgtacacagacactttctttttctcaataaatggcaactttatttatacatgctctctctcgggtattcatttccccaccacccaccacccgccgccgtaaccatctgctgctggctttttaaaaatcgaaagggttctgccgggaatcgccgtgcgccacgggcagggacacgttgcggaactggtagcgggtgccccacttgaactcgggcaccaccatgcggggcaagtcggggaagttgtcggcccacaggccgcgggtcagcaccagcgcgttcatcaggtcgggcgccgagatcttgaagtcgcagttggggccgccgccctgcgcgcgcgagttgcggtacaccgggttgcaacactggaacaccagcagcgccggataattcacgctggccagcacgctccggtcggagatcagctcggcgtccaggtcctccgcgttgctcagcgcgaacggggtcagcttgggcacctgccgccccaggaagggagcgtgccccggcttcgagttgcagtcgcagcgcagcgggatcagcaggtgcccgcggccggactcggcgttggggtacagcgcgcgcatgaaggcctccatctggcggaaggccatctgggccttggcgccctccgagaagaacatgccgcaggacttgcccgagaactggttcgcggggcagctagcgtcgtgcaggcagcagcgcgcgtcggtgttggcaatctgcaccacgttgcgcccccaccggttcttcacgatcttggccttggaagcctgctccttcagcgcgcgctgcccgttctcgctggtcacatccatctcgatcacgtgctccttgttcaccatgctgctgccgtgcagacacttcagctcgccctccacctcggtgcagcggtgctgccacagcgcgcagcccgtgggctcgaaatgcttgtaggtcacctccgcgtaggactgcaggtaggcctgcaggaagcgccccatcatggtcacgaaggtcttgttgctgctgaaggtcagctgcagcccgcggtgctcctcgttcagccaggccttgcacacggccgccagcgcctccacctggtcgggcagcatcttgaagttcagcttcagctcattctccacatggtacttgtccatcagcgcgcgcgcagcctccatgcccttctcccaggccgacaccagcggcaggctcaaggggttcaccaccgtcgcagtcgccgccgcgctttcgctttccgctccgctgttctcttcttcctcctcctcttcttcctcgccgcccgcgcgcagcccccgcaccacggggtcgtcttcctgcaggcgccgcaccgagcgcttgccgctcctgccctgcttgatgcgcacgggcgggttgctgaagcctaccatcaccagcgcggcctcttcttgctcgtcctcgctgtccactatgacctcgggggagggcgacctcagaaccgtggcgcgctgcctcttctttttcctgggggcgtttgcaagctccgcggccgcggccgccgccgaggtcgaaggccgagggctgggcgtgcgcggcaccagcgcgtcctgcgagccgtcctcgtcctcggactcgaggcggcagcgagcccgcttctttgggggcgcgcggggcggcggcggcgggggcggcggcgacggagacggggacgagacatcgtccagggtgggaggacggcgggccgcgccgcgtccgcgctcgggggtggtttcgcgctggtcctcttcccgactggccatctcccactgctccttctcctataggcagaaagagatcatggagtctctcatgcaagtcgagaaggaggaggacagcctaaccaccgccccctctgagccctccgccgccaccgccgcggacgacgcgcctaccaccgccgccaccaccaccaccattaccaccctacccggcgacgcagccccgatcgagaaggaagtgttgatcgagcaggacccgggttttgtgagcgaagaggaggatgaggaggatgaaaaggagaaggataccgccgcctcagtgccaaaagaggataaaaagcaagaccaggacgacgcagagacagatgaggcagcaatcgggcggggggacgagaggcatgatgatgatgatgatgacggctacctagacgtgggagacgacgtgctgcttaagcacctgcaccgccagtgcgtcatcgtctgcgacgcgctgcaggagcgctgcgaagtgcccctggacgtggcggaggtcagccgcgcctacgagcggcacctcttcgcgccacacgtgccccccaagcgccgggagaacggcacctgcgagcccaacccgcgcctcaacttctacccggtcttcgcggtacccgaggtgctggccacctaccacatcttcttccaaaactgcaagatccccctctcctgccgcgccaaccgcacccgcgccgacaaggcgctggccctgcggcagggcgcccacatacctgatatcgcctctctggaggaggtgcccaagatcttcgagggtctcggtcgcgacgagaaacgggcggcgaacgctctgcaaggagacagcgaaaacgagagtcactcgggggtgctggtggagctcgagggcgacaacgcgcgcctggccgtgctcaagcgcagcatcgaagtcacccacttcgcctacccggcgctcaacctgccccccaaggtcatgagtgtggtcatgagcgagctcatcatgcgccgcgcccagcccctggacgcggatgcaaacttgcaagagccctccgaggaaggcctgcccgcggtcagcgacgagcagctggcgcgctggctggagacccgcgaccccgcccagctggaggagcggcgcaagctcatgatggccgcggtgctcgtcaccgtggagctcgagtgtctgcagcgcttcttcggggaccccgagatgcagcgcaagctcgaggagaccctgcactacaccttccgccagggctacgtgcgccaggcctgcaagatctccaacgtggagctctgcaacctggtctcctacctgggcatcctgcacgagaaccgcctcgggcagaacgtcctgcactccaccctcaaaggggaggcgcgccgcgactacgtccgcgactgcgtctacctcttcctctgctacacgtggcagacagccatgggggtctggcagcagtgcctggaggagcgcaacctcaaggagctggagaagctcctcaggcgcgccctcagggacctctggaggggcttcaacgagcgctcggtggccgccgcgctggcggacatcatcttccccgagcgcctgctcaaaaccctgcagcagggcctgcccgacttcaccagccagagcatgctgcagaacttcaggaccttcatcctggagcgctcgggcatcctgccggccacctgctgcgcgctgcccagcgacttcgtgcccatcaggtacagggagtgcccgccgccgctctggggccactgctacctcttccagctggccaactacctcgcctaccactcggatctcatggaagacgtgagcggcgagggcctgctcgagtgccactgccgctgcaacctgtgcacgccccaccgctctctagtctgcaacccgcagctgctcagcgagagtcagattatcggtaccttcgagctgcagggtccctcgcccgacgaaaagtccgcggctccggggttgaaactcactccggggctgtggacttccgcctacctacgcaaatttgtacctgaagactaccacgcccacgagatcaggttttacgaagaccaatcccgcccgcccaaggcggagctcaccgcctgcgtcattacccagggccacatcctgggccaattgcaagccatcaacaaagcccgccaagagttcttgctgaaaaagggtcggggggtgtacctggacccccagtccggcgaggagctaaacccgctacccccgccgccgccccagcagcgggaccttgcttcccaggatggcacccagaaagaagcagccgccgccgccgccagcatacatgcttctggaggaagaggaggactgggacagtcaggcagaggaggtttcggacgaggacgaggaggaggagatgatggaagactgggaggaggacagcctagacgaggaagcttcagaggccgaagaggtggcagacgcaacaccatcaccctcggccgcagccccctcgccggcgcccccgaaatcctccgaccccagcagcagcgctataacctccgctcctccggcgccggcgcccacccgcagcagacccaaccgtagatgggacactacaggaaccggggtcggtaagtctaagtgccccccagcgccgcccccgcaacaggagcaacagcagcagcagcggcgacagggctaccgctcgtggcgcggacacaagaacgccatagtcgcctgcttgcaagactgcgggggcaacatctccttcgcccgccgcttcctgctcttccaccacggtgtggcttttccccgcaatgtcctgcattactaccgtcatctctacagcccctactgcggcggcagcggcgacccagagggagcggcggcagcagcagcgccagccacagcggcgaccacctaggaagacctccgcgggcaagacggcgggagccgggagacccgcggcggcggcggcagcggcggcagcgggcgcactgcgcctctcgcccaacgaacccctctcgacccgggagctcagacacaggatcttccccactctgtatgctatcttccagcagagcagaggccaggaacaggagctgaaaataaaaaacagatctctgcgctccctcacccgcagctgtctgtatcacaaaagcgaagatcagcttcggcgcacgctggaggacgcggaggcactcttcagcaaatactgcgcgctgactcttaaggactagccgcgcgcccttctcgaatttaggcgggagaaagactacgtcatcgccgaccgccgcccagcccacccagccgacatgagcaaagagattcccacgccctacatgtggagctaccagccgcagatgggactcgcggcgggagcggcccaagactactccacccgcatgaactacatgagcgcggggccccacatgatctcacgggttaatgggatccgcgccgagcgaaaccaaatactgctggaacaggcggccataaccgccacaccccgtcatgacctcaatccccgaaattggcccgccgcccttgtgtaccaggaaaccccctctgccaccaccgtggtacttccgcgtgacacccaggccgaagtccagatgactaactcaggggcgcagctcgcgggcggctttcgtcacggggtgcggccgcaccggccgggtatattacacctggcgatcagaggccgaggtattcagctcaacgacgagtcggtgagctcttcgctcggtctccgtccggacggaaccttccagatcgccggatcaggtcgctcctcattcacgcctcgccaggcgtacctgactctgcagacctcctcctcggagcctcgctccggcggcatcggcaccctccagttcgtggaggagttcgtgccctcggtctacttcaaccccttctcgggacctcccggacgctatcccgaccagttcatcccgaactttgacgcggtgaaggactcggcggacggctacgactgaatgtcaagtgctgaggcagagagcgttcgcctgaaacacctcgagcactgccgccgcttcgcctgcttcgcccgcagctccggtgagttctgctactttcagctgcccgaggagcataccgaggggccggcgcacggcgtccgcctaaccacccagggcgaggttacctgtacccttatccgggagtttaccctccgtcccctgctagtggagcgggagcggggttcttgtgtcataactatcgcctgcaactgccctaaccctggattacatcaagatctttgttgtcacctgtgcgctgagtataataaacgctgagatcagactctactggggctcctgtcgccatcctgtgaacgccaccgtcttcacccaccccgagcagccccaggcgaacctcacctgcggcctgcgtcggagggccaagaagtacctcacctggtacttcaacggcaccccctttgtggtttacaacagcttcgaccaggacggagttgccttgagagacgacctttccggtctcagctactccattcacaagaacaccaccctccacctcttccctccctacctgccgggaacctacgagtgcgtcaccggccgctgcacccacctcatccgcctgatcgtaaaccagacctttccgggaacacacctcttccccagaacaggaggtgagctcaggaaaccccctggggcccagggcggagacttaccttcgacccttgtggggttaggattttttatcgccgggttgctggctctcctgatcaaagcttccttgagatttgttctctccctttacttttatgaacagctcaacttctaataacgctaccttttctcaggaatcgggtagtaacttctcttctgaaatcgggctgggtgtgctgcttactctgttgatttttttccttatcatacttagccttctgtgcctcaggctcgccgcctgctgcgcacatatctacatctacagccggttgcttaactgctggggtcgccatccaagatgaacggggctcaggtgctatgtctgctggccctggtggcctgcagtgccgccgtcaattttgaggaacccgcttgcaatgtgactttcaagcctgaaggcgcacattgcaccactctggttaaatgtgtgacctctcatgagaaactgctcatcgcctacaaaaacaaaacaggcgagttcgcggtctatagcgtgtggcaacccggagaccataataactactcagtcaccgtcttcgagggtgcggagtctaagaaattcgattacacctttcccttcgaggagatgtgtgaagcggtcatgtacctgtccaaacagtacaagctgtggccccccacccccgaggcgtgtgtggaaaacactgggtctttctgctgtctctctctgacaatcactgtgcttgctctaatctgcacgctgctgtacatgaaattcaggcagaggcgaatctttatcgatgagaaaaaaatgccttgatcgctaacaccggctttctgtctgcagaatgaaagcaatcacctccctactaatcagcaccaccctccttgcgattgcccatgggttgacacgaatcgaagtgccagtggggtccaatgtcaccatggtgggccccgccggcaattcctccctgatgtgggaaaaatatgtccgtaatcaatgggatcattactgctctaatcgaatctgtatcaagcccagagccatctgcgacgggcaaaatctaactttgattgatgtgcaaatgacggatgctgggtactattacgggcagcggggagaaatgattaattactggcgaccccacaaggactacatgctgcatgtagtcaaggcagtccccactactaccacccccaccactaccactcccaccactcccactactaccacccccaccactactactagcactgctactaccgctgcccgcaaagctattacccgcaaaagcaccatgcttagcaccaagccccattctcactcccacgccggcgggcccaccggtgcggcctcagaaaccaccgagctttgcttctgccaatgcactaacgccagcgcccacgaactgttcgacctggagaatgaggatgatgaccagctgagctccgcttgcccggtcccgctgcccgcagagccggtcgccctgaagcagctcggtgatccatttaatgactctcctgtttatccctctcccgaatacccgcccgactctaccttccacatcacgggcaccaacgaccccaacctctccttctacctgatgctgctgctttgtatctctgtggtatcttccgcgctcatgttactgggcatgttctgctgcctcatctgccgcagaaagagaaagtctcgctctcagggccaaccactgatgcccttcccctaccccccagattttgcagataacaagatatgagcacgctgctgacactaaccgctttactcgcctgcgctctaacccttgtcgcttgcgaatccagataccacaatgtcacagttgtgacaggagaaaatgttacattcaactccacggccgacacccagtggtcatggagccaccacggtagctatgtatacatctgcaatagctccacctcccctagcgtgtcctctcccaagtaccactgcaatgccagcctgttcaccctcatcaacgcctccacctcggacaatggactctatgtaggctatgtgacacccggtgggcagggaaagacccacgcctacaacctgcaagttcgccacccctccaccagcgccaccacctctgccgcccctacccgcagcagcagcatcagcagcagcagcagcagcagcagattcctgactttaatcctagccagctcaacaaccaccgccaccgctgagaccacccacagctccgcgcccgaaaccacccacacccaccacccagagacgaccgcggcctccagcgaccagatgtcggccaacatcaccgcctcgggtcttgaacttgcttcaacccccaccccaaaaccagtggatgcagccgacgtctccgccctcgtcaatgactgggcggggctgggaatgtggtggttcgccataggcatgatggcgctctgcctgcttctgctctggctcatctgctgcctcaaccgcaggcgggccagacccatctatagacccatcattgttctcaaccccgctgatgatgggatccatagattggatggtctgaaaaacctacttttctcttttacagtatgataaattgagacatgcctcgcattttcatgtacttgacacttctcccactttttctggggtgttctacgctggccgccgtctctcacctcgaggtagactgcctcacacccttcactgtctacctgatttacggattggtcaccctcaccctcatctgcagcctaatcacagtagtcatcgccttcatccagtgcattgactacatctgtgtgcgcctcgcgtacctgagacaccacccgcagtaccgagacaggaacattgcccaacttctaagactgctctaatcatgcataagactgtgatctgcctcctcatcctcctctccctgcccgctctcgtctcatgccagcccaccacaaaacctccacgaaaaagacatgcctcctgtcgcttgagccaactgtggaatattcccaaatgctacaatgaaaagagcgagctttccgaagcctggctatatgcggtcatgtgtgtccttgtcttctgcagcacaatctttgccctcatgatctacccccactttgatttgggatggaatgcggtcgatgccatgaattaccctacctttcccgcgcccgatatgattccactccgacaggttgtggtgcccgtcgccctcaatcaacgccccccatcccctacacccactgaggtcagctactttaatctaacaggcggagatgactgacactctagatctagaaatggacggcatcggcaccgagcagcgtctcctacagaggcgcaagcaggcggctgaacaagagcgcctcaatcaggagcttcgagatctcattaacctgcaccagtgcaaaaaaggcatcttttgcctggtcaagcaggccgatgtcacctacgagaaaaccggtaacagccaccgcctcagctacaagctgcccacccaacgccagaagttggtgctcatggtgggtcagaatcccatcaccgtcacccagcactcggtggagaccgaggggtgtctgcactccccctgtcagggtccggaagacctctgcaccctggtaaagaccctgtgtggtcttagagatttaatcccctttaactaatcaaacactggaatcaataaaaagaatcacttactttaaatcagtcagcaggtctctgtccactttattcagcagcacctccttcccctcctcccaactctggtactccaaacgcctcctggcggcaaacttcctccacaccctgaagggaatgtcagattcttgctcctgtccctccgcacccactatcttcatgttgttgcagatgaagcgcgccaaaacgtctgacgagaccttcaaccccgtgtacccctatgacacggaaaacgggcctccctccgtccctttcctcacccctcccttcgtgtcccccgacggatttcaagaaagccccccaggggtcctgtctctgcgcctgtcagagcccctggtcacttcccacggcatgcttgccctgaaaatgggaaatggcctctccctggatgacgccggcaacctcacctctcaagatgtcaccaccgtcacccctcccctcaaaaaaaccaagaccaacctcagcctccagacctcagcccccctgaccgttagctctgggtccctcaccgtcgcggccgccgctccactggcggtggccggcacctctctcaccatgcaatctcaggcccccttgacggtgcaagatgcaaaactgagtctggccacccagggacccctaaccgtgtctgaaggcaaactcaccttgcagacatcggctccacttacggccgccgacagcagcactctcactgttggcaccacaccgccaatcagtgtgagcagtggaagtctaggcttagatatggaagaccccatgtatactcatgatggaaaactgggaatcagaattggtggcccactgcaagtagtagacagcttgcacacactcactgtagttactggaaacggaataactgtagctaacaatgcccttcaaactaaagttgcgggtgccctgggttatgactcatctggcaatctagaattgcgagccgcagggggtatgcgaattaacacagggggtcaactcattcttgatgtggcttatccatttgatgctcagaacaatctcagccttagacttggtcagggacctttatatgtgaacaccaatcacaacctagatttaaattgcaacagaggtctgaccacaaccaccagcagtaacacaaccaaacttgaaactaaaatcgattcgggcttagactataacgccaatggggctatcattgctaaacttggcactgggttaacctttgacaacacaggtgccataactgtgggaaacactggggatgacaaactcactctgtggactaccccagatccctctcctaactgcagaattcacgcagacaaagactgcaagtttactctagtcctgactaagtgtggaagtcaaattctggcctccgtcgccgccctggcggtgtctggaaacctatcatcaatgacaggcactgtctccagcgttaccatctttctcagattcgatcagaatggagttcttatggaaaattcctcgctagacaaggagtactggaacttcagaaatggtaattccaccaatgccaccccctacaccaatgcggttgggttcatgcccaacctcagcgcctaccccaaaacccagagtcaaactgcaaaaaacaacattgtaagtgaggtttacttacatggggacaaatctaaacccatgatccttaccattacccttaatggcacaaatgaatccagtgaaactagtcaggtgagtcactactccatgtcatttacatggtcctgggacagtgggaaatatgccaccgaaacctttgccaccaactcttttaccttctcctacattgctgaacaataaagaagcataacgctgctgttcatttgtaatcaagtgttacttttttatttttcaattacaacagaatcattcaagtcattctccatttagcttaatagacccagtagtgcaaagccccatactagcttatttcagacagtataaattaaaccataccttttgatttcaatattaaaaaaatcatcacaggatcctagtcgtcaggccgccccctccctgccaagacacagaatacacaatcctctccccccgactggctttaaacaacaccatctggttggtgacagacaggttcttcggggttatattccacacggtctcctggcgggccaggcgctcgtcggtgatgctgataaactctcccggcagctcgctcaagttcacgtcgctgtccagcggctgaacctcatgctgacgcggtaactgcgcgaccggctgctgaacaaacggaggccgcgcctacaagggggtagagtcataatcctccgtcaggatagggcggttatgcagcagcagcgagcgaatcatctgctgccgccgccgctccgtccggcaggaaaacaacatcccggtggtctcctccgctataatccgcaccgcccgcagcatgagctttctcgttctccgcgcgcagcaccgcaccctgatctcgctcaggttggcgcagtaggtacagcacatcaccacgatgttattcatgatcccacagtgcaaggcgctgtatccaaagctcatgcccgggaccaccgcccccacgtgaccgtcgtaccagaagcgcaggtaaatcaagtgccgacccctcatgaacgtgctggacataaacatcacctccttgggcatgttgtaattcaccacctcccggtaccagatgaatctctgattgaacacggccccttccaccaccatcctgaaccaagaggctaggacctgcccaccggctatgcactgcagggaaccagggttggaacaatgacaatgcagactccagggctcgtaaccgtggatcatccggctgctgaagacatcgatgttggcgcaacacagacacacgtgcatacacttcctcatgattagcagctcctccctcgtcaggatcatatcccaagggataacccattcttgaatcaacgtaaagcccacagagcagggaaggcctcgcacataactcacgttgtgcatggtcagcgtgttgcattccggaaacagcggatgatcctccagtatcgaggcgcgggtctcgttctcacagggaggtaaaggggccctgctgtacggactgtggcgggacgaccgagatcgtgttgagcgtaacgtcatggaaaagggaacgccggacgtggtcatacttcttgaagcagaaccaggctcgcgcgtgacagacctccttgcgtctacggtctcgccgcttagctcgctccgtgtgatagttgtagtacagccactctctcaaagcgtcgaggcgacacctggcgtcaggatgtatgtagactccgtcttgcaccgcggccctgataatatccaccaccgtagaataagccacaccaagccaagcaatacactcgctctgcgagcggcagacaggaggagcggggagagacggaaggaccatcataaaattttaaagaatattttccaatatttcgaaatcaagatctaccaaatggcagcgctcccctccactggcgcggtcaaactctacggccaaagaacagataacggcatttttaagatgttcccggacggcgtctaaaagacaaaccgctctcaagtcgacataaattataagccaaaagccatcgggttcaagatccactatggacgcgccggcggcgtccaccaaacccaaataattttcttctctccagcgctgcaaaatcccagtaagcaactccctgatattaagatgaaccatgccaaaaatctgttcaagagcgccctccaccttcattctcaagcagcgcatcatgattgcaaaaattcaggttcctcagacacctgtatgagattcaaaacgggaatattaacaaaaattcctctgtcgcgcagatcccttcgcagggcaagctgaacataatcagacaggtctgaacgaaccagcgaggccaaatccccgccaggaaccagatccagagaccctatgctgattatgacgcgcatactcggggctatgctaaccagcgtagcgccgatgtaggcgtgctgcatgggcggcgaaataaaatgcaaggtgctggttaaaaaatcaggcaaagcctcgcgcaaaaaagctaagacatcataatcatgctcatgcaggtagttgcaggtaagctcaggaaccaaaacggaataacacacgattttcctctcaaacatgacttccaggtgactgcataagaaaaaaattataaataataaatattaattaaataaattaaacattggaagcctgtctcacaacaggaaaaaccactctgatcaacataagacgggccacgggcatgcccgcgtgaccataaaaaaatcggtctccgtgattacaaagcaccacagatagctccccggtcatgtcgggggtcatcatgtgagactgtgtatacacgtccgggctgttgacatcggtcaaagaaagaaatcgagctacatagcccggaggaatcaacacccgcacgcggaggtacagcaaaacggtccccataggaggaatcacaaaattagtaggagaaaaaaaaacataaacaccagaaaaaccctcctgccgaggcaaaacagcgccctcccgttccaaaacaacataaagcgcttccacaggagcagccatgacaaagacccgagtcttaccaggaaaattttaaaaaagattcctcaacgcagcaccagcaccaacacctgtcagtgtaaaatgccaagcgccgagcgagtatatataggaataaaaagtgacgtaaacggttaaagtccagaaaacgcccagaaaaaccgcacgcgaacctacgccccgaaacgaaagccaaaaaacagtaaacacgccctttcggcgtcaacttccgctttcccacggtacgtcacttccgcatatagtaaaactacgctacccaacatgcaaaaagccacggcccaaaacacgtcacacctcccgggccgccccgcgccgccgccccgccccgcgcctcccaactccgccccactccgcccacctcattatcatattggcttcaatccaaaataaggtatattattgatgatg

SEQ ID NO: 96 - protein, 217 aa, Unknown; identical to SEQ ID NO: 65
  Synthetic Construct

SEQ ID NO: 97 - protein, 147 aa, Unknown; identical to SEQ ID NO: 35
  Synthetic Construct

SEQ ID NO: 98 - protein, 419 aa, Unknown
  Synthetic Construct
MHPVLRQMRPPPQQQQQHQQERHQQQRESCRAPSPTLGGPATSASAAVSGAGGGGLADDPEEPPRRRARQYLDLEEGEGLARLGAPSPERHPRVQLKRDSREAYVPRQNLFRDRAGEEPEEMRDRRFAAGRELRQGLNRERLLREEDFEPDARTGISPARAHVAAADLVTAYEQTVNQEINFQKSFNNHVRTLVAREEVTIGLMHLWDFVCALEQNPNSKPLTAQLFLIVQHSRDNEAFRDALLNITEPEGRWLLDLINILQSIVVQERSLSLADKVAAINYSMLSLGKFYARKIYQTPYVPIDKEVKIDGFYMRMALKVLTLSDDLGVYRNERIHKAVSVSRRRELSDRELMHSLQRALAGAGSGDREAESYFEAGADLRWVPSRRALEAAGARREDYADEEEEDDEEYELEEGEYLD

SEQ ID NO: 99 - protein, 590 aa, Unknown; identical to SEQ ID NO: 68
  Synthetic Construct

SEQ ID NO: 100 - protein, 581 aa, Unknown
  Synthetic Construct
MRRAAMYHEGPPPSYESVVGAAAASPFASQLEPPYVPPRYLRPTGGRNSIRYSELAPLYDTTRVYLVDNKSADVASLNYQNDHSNFLTTVIQNNDYTPSEASTQTINLDDRSHWGGDLKTILHTNMPNVNEFMFTNKFKARVMVSRSHTKDDRVELKYEWVEFELPEGNYSETMTIDLMNNAIVEHYLKVGRQNGVLESDIGVKFDTRNFRLGLDPVTGLVMPGVYTNEAFHPDIILLPGCGVDFTYSRLSNLLGIRKRQPFQEGFRITYEDLEGGNIPALLDVEAYQDSLKEEEAGEGSGGGAGQEEGGASSEASADPAAAAEAEAADPAMVVEEEKDMNDEAVRGDTFATRGEEKKAEAEAAAEEAAAAAAAVEAAAEAEKPPKEPVIKPLTEDSKKRSYNVLKDSTNTEYRSWYLAYNYGDPATGVRSWTLLCTPDVTCGSEQVYWSLPDMMQDPVTFRSTRQVSNFPVVGAELLPVHSKSFYNDQAVYSQLIRQFTSLTHVFNRFPENQILARPPAPTITTVSENVPALTDHGTLPLRNSIGGVQRVTVTDARRRTCPYVYKALGIVSPRVLSSRTF

SEQ ID NO: 101 - protein, 199 aa, Unknown; identical to SEQ ID NO: 39
  Synthetic Construct

SEQ ID NO: 102 - protein, 364 aa, Unknown
  Synthetic Construct
MSKRKIKEEMLQVVAPEIYGPPKKEEQDFKPRKIKRVKKKKKDDDDGEVEFLRATAPRRPLQWKGRRVKRVLRPGTAVVFTPGERSTRTFKRVYDEVYGDEDLLEQANDRSGEFAYGKRHRAMEKDEVLALPLDRGNPTPSLKPVTLQQVLPASAPSEMKRGLKREGGDLAPTVQLMVPKRQRLEDVLEKMKVDPGLQPDIRVRPIKQVAPGLGVQTVDVVIPTGASSSSAAAAATSTADMETQTSPAATSSAEVQTDPWLPPPATAPSRARRGRRKYGAASALMPEYALHPSIAPTPGYRGYSYRPRRAKGSTRRSRRAATSTRRRSRRRRRQPALAPISVKRVARNGNTLVLPRARYHPSIV

SEQ ID NO: 103 - protein, 80 aa, Unknown; identical to SEQ ID NO: 41
  Synthetic Construct

SEQ ID NO: 104 - protein, 259 aa, Unknown; identical to SEQ ID NO: 42
  Synthetic Construct

SEQ ID NO: 105 - protein, 962 aa, Unknown
  Synthetic Construct
MATPSMMPQWSYMHISGQDASEYLSPGLVQFARATDSYFSLSNKFRNPTVAPTHDVTTDRSQRLTLRFIPVDREDTAYSYKARFTLAVGDNRVLDMASTYFDIRGVLDRGPTFKPYSGTAYNSLAPKGAPNSCEWEQVEPAEEAAENEDEEEEEDVVDPQEQEPTTKTHVYAQAPLSGEKITKDGLQIGTEATAAGGTKDLFADPTFQPEPQVGESQWNEADATAAGGRVLKKTTPMKPCYGSYARPTNANGGQGVLKANAQGVLESQVEMQFFSTSTNATNEQNNIQPKLVLYSEDVHMETPDTHISYKPTKSDDNSKVMLGQQSMPNRPNYIAFRDNFIGLMYYNSTGNMGVLAGQASQLNAVVDLQDRNTELSYQLLLDSMGDRTRYFSMWNQAVDSYDPDVRIIENHGTEDELPNYCFPLGGIGITDTYQAIKTNGNGAGDQATTWQKDSQFADRNEIGVGNNFAMEINLSANLWRNFLYSNVALYLPDKLKYNPSNVEISDNPNTYDYMNKRVVAPGLVDCYINLGARWSLDYMDNVNPFNHHRNAGLRYRSMLLGNGRYVPFHIQVPQKFFAIKNLLLLPGSYTYEWNFRKDVNMVLQSSLGNDLRVDGASIKFESICLYATFFPMAHNTASTLEAMLRNDTNDQSFNDYLSAANMLYPIPANATNVPISIPSRNWAAFRGWAFTRLKTKETPSLGSGFDPYYTYSGSIPYLDGTFYLNHTFKKVSVTFDSSVSWPGNDRLLTPNEFEIKRSVDGEGYNVAQCNMTKDWFLIQMLANYNIGYQGFYIPESYKDRMYSFFRNFQPMSRQVVDETKYKDYQQVGIIHQHNNSGFVGYLAPTMREGQAYPANFPYPLIGKTAVDSITQKKFLCDRTLWRIPFSSNFMSMGALTDLGQNLLYANSAHALDMTFEVDPMDEPTLLYVLFEVFDVVRVHQPHRGVIETVYLRTPFSAGNATT

SEQ ID NO: 106 - protein, 211 aa, Unknown; identical to SEQ ID NO: 75
  Synthetic Construct

SEQ ID NO: 107 - protein, 832 aa, Unknown
  Synthetic Construct
MESLMQVEKEEDSLTTAPSEPSAATAADDAPTTAATTTTITTLPGDAAPIEKEVLIEQDPGFVSEEEDEEDEKEKDTAASVPKEDKKQDQDDAETDEAAIGRGDERHDDDDDDGYLDVGDDVLLKHLHRQCVIVCDALQERCEVPLDVAEVSRAYERHLFAPHVPPKRRENGTCEPNPRLNFYPVFAVPEVLATYHIFFQNCKIPLSCRANRTRADKALALRQGAHIPDIASLEEVPKIFEGLGRDEKRAANALQGDSENESHSGVLVELEGDNARLAVLKRSIEVTHFAYPALNLPPKVMSVVMSELIMRRAQPLDADANLQEPSEEGLPAVSDEQLARWLETRDPAQLEERRKLMMAAVLVTVELECLQRFFGDPEMQRKLEETLHYTFRQGYVRQACKISNVELCNLVSYLGILHENRLGQNVLHSTLKGEARRDYVRDCVYLFLCYTWQTAMGVWQQCLEERNLKELEKLLRRALRDLWRGFNERSVAAALADIIFPERLLKTLQQGLPDFTSQSMLQNFRTFILERSGILPATCCALPSDFVPIRYRECPPPLWGHCYLFQLANYLAYHSDLMEDVSGEGLLECHCRCNLCTPHRSLVCNPQLLSESQIIGTFELQGPSPDEKSAAPGLKLTPGLWTSAYLRKFVPEDYHAHEIRFYEDQSRPPKAELTACVITQGHILGQLQAINKARQEFLLKKGRGVYLDPQSGEELNPLPPPPPQQRDLASQDGTQKEAAAAAASIHASGGRGGLGQSGRGGFGRGRGGGDDGRLGGGQPRRGSFRGRRGGRRNTITLGRSPLAGAPEILRPQQQRYNLRSSGAGAHPQQTQP

SEQ ID NO: 108 - protein, 227 aa, Unknown; identical to SEQ ID NO: 46
  Synthetic Construct

SEQ ID NO: 109 - protein, 105 aa, Unknown; identical to SEQ ID NO: 57
  Synthetic Construct

SEQ ID NO: 110 - protein, 169 aa, Unknown
  Synthetic Construct
IRLYWGSCRHPVNATVFTHPEQPQANLTCGLRRRAKKYLTWYFNGTPFVVYNSFDQDGVALRDDLSGLSYSIHKNTTLHLFPPYLPGTYECVTGRCTHLIRLIVNQTFPGTHLFPRTGGELRKPPGAQGGDLPSTLVGLGFFIAGLLALLIKASLRFVLSLYFYEQLNF

SEQ ID NO: 111 - protein, 159 aa, Unknown
  Synthetic Construct
MNGAQVLCLLALVACSAAVNFEEPACNVTFKPEGAHCTTLVKCVTSHEKLLIAYKNKTGEFAVYSVWQPGDHNNYSVTVFEGAESKKFDYTFPFEEMCEAVMYLSKQYKLWPPTPEACVENTGSFCCLSLTITVLALICTLLYMKFRQRRIFIDEKKMP

SEQ ID NO: 112 - protein, 303 aa, Unknown; identical to SEQ ID NO: 80
  Synthetic Construct

SEQ ID NO: 113 - protein, 90 aa, Unknown; identical to SEQ ID NO: 50
  Synthetic Construct

SEQ ID NO: 114 - protein, 133 aa, Unknown; identical to SEQ ID NO: 51
  Synthetic Construct

SEQ ID NO: 115 - DNA, 1540 bp, Unknown
  Simian adenovirus 44
  CDS (8)..(1531): E1b\55K
aggataaatggagcgaagagacccacttgagttcgggatacgtcctggattttctggccatacaactgtggagagcatggatcaggcacaagaacagaatgcaactgttgtcttccgtccgtccgttgctgattcagccggaggagcagcagaccgggccggaggaccgggctcgtccggaaccagaggagagggcgcccgcggcggcgccggagaggagcgcgtggaacctgggagccggcctgaacggccatccacatcgggagtgaatgttggacaggtggcggatctctttccagaactgcgacgaatcttgactattagggaggatggacaatttgttaagggccttaagagggagcggggggcttctgaacataacgaggaggccagtaatttagcttttagtctgatgaccagacaccgtcccgagtgcattacttttcagcagattaaagataattgtgccaatgagttagatctgctgggtcagaagtacagcatagagcagttgaccacttactggttgcagccgggtgatgatctggaggaagctattagggtgtatgccaaggtggccctgaggcccgattgcaagtacaagctcaaggggctggtgaatatcaggaattgttgctacgtttctgggaacggggcggaggtggagatagagaccgatgacagggtggcctttaggtgcagcatgatgaatatgtggcctggggtgctgggcatggacggggtggtgattatgaatgtgaggttcacggggcccaattttaatggcacggtgttcctgggcaacaccaacctggtgctgcacggggtgagcttctatggctttaacaacacctgtgtggaggcctggaccgatgtgaaggtccgtggctgtgccttctacggatgttggaaggcggtagtgtgtcgccccaagagcaggagttccattaaaaaatgcttgtttgagaggtgcaccctgggggtgctggcggagggcaactgtcgggtgcgccacaatgtggcctccgaatgcggttgcttcatgctagtgaagagcgtggcggtcatcaagcataacatggtgtgcggcaacagcgaggacaaggcctcgcagatgctgacctgctcggatggcaactgccacttactcaagaccatccatataaccagccacagccgcaaggcctggcccgtgttcgagcacaacgtgttgacccgctgctccttgcatctgggcaacaggaggggtgtgttcctgccctatcaatgcaacttgagccacaccaaggtcttgctagagcccgaaagcatgtccaaggtgaacctgaacggggtgtttgacatgaccctgaagatatggaaggtgctgaggtacgacgagaccaggtcccggtgcaggccctgcgagtgcgggggcaagcatatgaggaaccagcctgtgatgctggatgtgaccgaggagctgaggcctgaccacttggttctggcctgcaccagggccgagtttggttctagcgatgaagacacagactgaggtggg

SEQ ID NO: 116 - protein, 508 aa, Unknown
  Synthetic Construct
MERRDPLEFGIRPGFSGHTTVESMDQAQEQNATVVFRPSVADSAGGAADRAGGPGSSGTRGEGARGGAGEERVEPGSRPERPSTSGVNVGQVADLFPELRRILTIREDGQFVKGLKRERGASEHNEEASNLAFSLMTRHRPECITFQQIKDNCANELDLLGQKYSIEQLTTYWLQPGDDLEEAIRVYAKVALRPDCKYKLKGLVNIRNCCYVSGNGAEVEIETDDRVAFRCSMMNMWPGVLGMDGVVIMNVRFTGPNFNGTVFLGNTNLVLHGVSFYGFNNTCVEAWTDVKVRGCAFYGCWKAVVCRPKSRSSIKKCLFERCTLGVLAEGNCRVRHNVASECGCFMLVKSVAVIKHNMVCGNSEDKASQMLTCSDGNCHLLKTIHITSHSRKAWPVFEHNVLTRCSLHLGNRRGVFLPYQCNLSHTKVLLEPESMSKVNLNGVFDMTLKIWKVLRYDETRSRCRPCECGGKHMRNQPVMLDVTEELRPDHLVLACTRAEFGSSDEDTD

SEQ ID NO: 117 - DNA, 7860 bp, Unknown
  Simian adenovirus 44
  CDS (9)..(629): 22K
  CDS (4136)..(4951): E3\CR1-gamma
  CDS (5635)..(6018): E3\14.7K
  CDS (6173)..(7852): fiber
ttcccaggatggcacccagaaagaagcagccgccgccgccgccagcatacatgcttctggaggaagaggaggactgggacagtcaggcagaggaggtttcggacgaggacgaggaggaggagatgatggaagactgggaggaggacagcctagacgaggaagcttcagaggccgaagaggtggcagacgcaacaccatcaccctcggccgcagccccctcgccggcgcccccgaaatcctccgaccccagcagcagcgctataacctccgctcctccggcgccggcgcccacccgcagcagacccaaccgtagatgggacactacaggaaccggggtcggtaagtctaagtgccccccagcgccgcccccgcaacaggagcaacagcagcagcagcggcgacagggctaccgctcgtggcgcggacacaagaacgccatagtcgcctgcttgcaagactgcgggggcaacatctccttcgcccgccgcttcctgctcttccaccacggtgtggcttttccccgcaatgtcctgcattactaccgtcatctctacagcccctactgcggcggcagcggcgacccagagggagcggcggcagcagcagcgccagccacagcggcgaccacctaggaagacctccgcgggcaagacggcgggagccgggagacccgcggcggcggcggcagcggcggcagcgggcgcactgcgcctctcgcccaacgaacccctctcgacccgggagctcagacacaggatcttccccactctgtatgctatcttccagcagagcagaggccaggaacaggagctgaaaataaaaaacagatctctgcgctccctcacccgcagctgtctgtatcacaaaagcgaagatcagcttcggcgcacgctggaggacgcggaggcactcttcagcaaatactgcgcgctgactcttaaggactagccgcgcgcccttctcgaatttaggcgggagaaagactacgtcatcgccgaccgccgcccagcccacccagccgacatgagcaaagagattcccacgccctacatgtggagctaccagccgcagatgggactcgcggcgggagcggcccaagactactccacccgcatgaactacatgagcgcggggccccacatgatctcacgggttaatgggatccgcgccgagcgaaaccaaatactgctggaacaggcggccataaccgccacaccccgtcatgacctcaatccccgaaattggcccgccgcccttgtgtaccaggaaaccccctctgccaccaccgtggtacttccgcgtgacacccaggccgaagtccagatgactaactcaggggcgcagctcgcgggcggctttcgtcacggggtgcggccgcaccggccgggtatattacacctggcgatcagaggccgaggtattcagctcaacgacgagtcggtgagctcttcgctcggtctccgtccggacggaaccttccagatcgccggatcaggtcgctcctcattcacgcctcgccaggcgtacctgactctgcagacctcctcctcggagcctcgctccggcggcatcggcaccctccagttcgtggaggagttcgtgccctcggtctacttcaaccccttctcgggacctcccggacgctatcccgaccagttcatcccgaactttgacgcggtgaaggactcggcggacggctacgactgaatgtcaagtgctgaggcagagagcgttcgcctgaaacacctcgagcactgccgccgcttcgcctgcttcgcccgcagctccggtgagttctgctactttcagctgcccgaggagcataccgaggggccggcgcacggcgtccgcctaaccacccagggcgaggttacctgtacccttatccgggagtttaccctccgtcccctgctagtggagcgggagcggggttcttgtgtcataactatcgcctgcaactgccctaaccctggattacatcaagatctttgttgtcacctgtgcgctgagtataataaacgctgagatcagactctactggggctcctgtcgccatcctgtgaacgccaccgtcttcacccaccccgagcagccccaggcgaacctcacctgcggcctgcgtcggagggccaagaagtacctcacctggtacttcaacggcaccccctttgtggtttacaacagcttcgaccaggacggagttgccttgagagacgacctttccggtctcagctactccattcacaagaacaccaccctccacctcttccctccctacctgccgggaacctacgagtgcgtcaccggccgctgcacccacctcatccgcctgatcgtaaaccagacctttccgggaacacacctcttccccagaacaggaggtgagctcaggaaaccccctggggcccagggcggagacttaccttcgacccttgtggggttaggattttttatcgccgggttgctggctctcctgatcaaagcttccttgagatttgttctctccctttacttttatgaacagctcaacttctaataacgctaccttttctcaggaatcgggtagtaacttctcttctgaaatcgggctgggtgtgctgcttactctgttgatttttttccttatcatacttagccttctgtgcctcaggctcgccgcctgctgcgcacatatctacatctacagccggttgcttaactgctggggtcgccatccaagatgaacggggctcaggtgctatgtctgctggccctggtggcctgcagtgccgccgtcaattttgaggaacccgcttgcaatgtgactttcaagcctgaaggcgcacattgcaccactctggttaaatgtgtgacctctcatgagaaactgctcatcgcctacaaaaacaaaacaggcgagttcgcggtctatagcgtgtggcaacccggagaccataataactactcagtcaccgtcttcgagggtgcggagtctaagaaattcgattacacctttcccttcgaggagatgtgtgaagcggtcatgtacctgtccaaacagtacaagctgtggccccccacccccgaggcgtgtgtggaaaacactgggtctttctgctgtctctctctgacaatcactgtgcttgctctaatctgcacgctgctgtacatgaaattcaggcagaggcgaatctttatcgatgagaaaaaaatgccttgatcgctaacaccggctttctgtctgcagaatgaaagcaatcacctccctactaatcagcaccaccctccttgcgattgcccatgggttgacacgaatcgaagtgccagtggggtccaatgtcaccatggtgggccccgccggcaattcctccctgatgtgggaaaaatatgtccgtaatcaatgggatcattactgctctaatcgaatctgtatcaagcccagagccatctgcgacgggcaaaatctaactttgattgatgtgcaaatgacggatgctgggtactattacgggcagcggggagaaatgattaattactggcgaccccacaaggactacatgctgcatgtagtcaaggcagtccccactactaccacccccaccactaccactcccaccactcccactactaccacccccaccactactactagcactgctactaccgctgcccgcaaagctattacccgcaaaagcaccatgcttagcaccaagccccattctcactcccacgccggcgggcccaccggtgcggcctcagaaaccaccgagctttgcttctgccaatgcactaacgccagcgcccacgaactgttcgacctggagaatgaggatgatgaccagctgagctccgcttgcccggtcccgctgcccgcagagccggtcgccctgaagcagctcggtgatccatttaatgactctcctgtttatccctctcccgaatacccgcccgactctaccttccacatcacgggcaccaacgaccccaacctctccttctacctgatgctgctgctttgtatctctgtggtatcttccgcgctcatgttactgggcatgttctgctgcctcatctgccgcagaaagagaaagtctcgctctcagggccaaccactgatgcccttcccctaccccccagattttgcagataacaagatatgagcacgctgctgacactaaccgctttactcgcctgcgctctaacccttgtcgcttgcgaatccagataccacaatgtcacagttgtgacaggagaaaatgttacattcaactccacggccgacacccagtggtcatggagccaccacggtagctatgtatacatctgcaatagctccacctcccctagcgtgtcctctcccaagtaccactgcaatgccagcctgttcaccctcatcaacgcctccacctcggacaatggactctatgtaggctatgtgacacccggtgggcagggaaagacccacgcctacaacctgcaagttcgccacccctccaccagcgccaccacctctgccgcccctacccgcagcagcagcatcagcagcagcagcagcagcagcagattcctgactttaatcctagccagctcaacaaccaccgccaccgctgagaccacccacagctccgcgcccgaaaccacccacacccaccacccagagacgaccgcggcctccagcgaccagatgtcggccaacatcaccgcctcgggtcttgaacttgcttcaacccccaccccaaaaccagtggatgcagccgacgtctccgccctcgtcaatgactgggcggggctgggaatgtggtggttcgccataggcatgatggcgctctgcctgcttctgctctggctcatctgctgcctcaaccgcaggcgggccagacccatctatagacccatcattgttctcaaccccgctgatgatgggatccatagattggatggtctgaaaaacctacttttctcttttacagtatgataaattgagacatgcctcgcattttcatgtacttgacacttctcccactttttctggggtgttctacgctggccgccgtctctcacctcgaggtagactgcctcacacccttcactgtctacctgatttacggattggtcaccctcaccctcatctgcagcctaatcacagtagtcatcgccttcatccagtgcattgactacatctgtgtgcgcctcgcgtacctgagacaccacccgcagtaccgagacaggaacattgcccaacttctaagactgctctaatcatgcataagactgtgatctgcctcctcatcctcctctccctgcccgctctcgtctcatgccagcccaccacaaaacctccacgaaaaagacatgcctcctgtcgcttgagccaactgtggaatattcccaaatgctacaatgaaaagagcgagctttccgaagcctggctatatgcggtcatgtgtgtccttgtcttctgcagcacaatctttgccctcatgatctacccccactttgatttgggatggaatgcggtcgatgccatgaattaccctacctttcccgcgcccgatatgattccactccgacaggttgtggtgcccgtcgccctcaatcaacgccccccatcccctacacccactgaggtcagctactttaatctaacaggcggagatgactgacactctagatctagaaatggacggcatcggcaccgagcagcgtctcctacagaggcgcaagcaggcggctgaacaagagcgcctcaatcaggagcttcgagatctcattaacctgcaccagtgcaaaaaaggcatcttttgcctggtcaagcaggccgatgtcacctacgagaaaaccggtaacagccaccgcctcagctacaagctgcccacccaacgccagaagttggtgctcatggtgggtcagaatcccatcaccgtcacccagcactcggtggagaccgaggggtgtctgcactccccctgtcagggtccggaagacctctgcaccctggtaaagaccctgtgtggtcttagagatttaatcccctttaactaatcaaacactggaatcaataaaaagaatcacttactttaaatcagtcagcaggtctctgtccactttattcagcagcacctccttcccctcctcccaactctggtactccaaacgcctcctggcggcaaacttcctccacaccctgaagggaatgtcagattcttgctcctgtccctccgcacccactatcttcatgttgttgcagatgaagcgcgccaaaacgtctgacgagaccttcaaccccgtgtacccctatgacacggaaaacgggcctccctccgtccctttcctcacccctcccttcgtgtcccccgacggatttcaagaaagccccccaggggtcctgtctctgcgcctgtcagagcccctggtcacttcccacggcatgcttgccctgaaaatgggaaatggcctctccctggatgacgccggcaacctcacctctcaagatgtcaccaccgtcacccctcccctcaaaaaaaccaagaccaacctcagcctccagacctcagcccccctgaccgttagctctgggtccctcaccgtcgcggccgccgctccactggcggtggccggcacctctctcaccatgcaatctcaggcccccttgacggtgcaagatgcaaaactgagtctggccacccagggacccctaaccgtgtctgaaggcaaactcaccttgcagacatcggctccacttacggccgccgacagcagcactctcactgttggcaccacaccgccaatcagtgtgagcagtggaagtctaggcttagatatggaagaccccatgtatactcatgatggaaaactgggaatcagaattggtggcccactgcaagtagtagacagcttgcacacactcactgtagttactggaaacggaataactgtagctaacaatgcccttcaaactaaagttgcgggtgccctgggttatgactcatctggcaatctagaattgcgagccgcagggggtatgcgaattaacacagggggtcaactcattcttgatgtggcttatccatttgatgctcagaacaatctcagccttagacttggtcagggacctttatatgtgaacaccaatcacaacctagatttaaattgcaacagaggtctgaccacaaccaccagcagtaacacaaccaaacttgaaactaaaatcgattcgggcttagactataacgccaatggggctatcattgctaaacttggcactgggttaacctttgacaacacaggtgccataactgtgggaaacactggggatgacaaactcactctgtggactaccccagatccctctcctaactgcagaattcacgcagacaaagactgcaagtttactctagtcctgactaagtgtggaagtcaaattctggcctccgtcgccgccctggcggtgtctggaaacctatcatcaatgacaggcactgtctccagcgttaccatctttctcagattcgatcagaatggagttcttatggaaaattcctcgctagacaaggagtactggaacttcagaaatggtaattccaccaatgccaccccctacaccaatgcggttgggttcatgcccaacctcagcgcctaccccaaaacccagagtcaaactgcaaaaaacaacattgtaagtgaggtttacttacatggggacaaatctaaacccatgatccttaccattacccttaatggcacaaatgaatccagtgaaactagtcaggtgagtcactactccatgtcatttacatggtcctgggacagtgggaaatatgccaccgaaacctttgccaccaactcttttaccttctcctacattgctgaacaataaagaag

SEQ ID NO: 118 - protein, 207 aa, Unknown; identical to SEQ ID NO: 56
  Synthetic Construct

SEQ ID NO: 119 - protein, 272 aa, Unknown
  Synthetic Construct
MSTLLTLTALLACALTLVACESRYHNVTVVTGENVTFNSTADTQWSWSHHGSYVYICNSSTSPSVSSPKYHCNASLFTLINASTSDNGLYVGYVTPGGQGKTHAYNLQVRHPSTSATTSAAPTRSSSISSSSSSSRFLTLILASSTTTATAETTHSSAPETTHTHHPETTAASSDQMSANITASGLELASTPTPKPVDAADVSALVNDWAGLGMWWFAIGMMALCLLLLWLICCLNRRRARPIYRPIIVLNPADDGIHRLDGLKNLLFSFTV

SEQ ID NO: 120 - protein, 128 aa, Unknown; identical to SEQ ID NO: 59
  Synthetic Construct

SEQ ID NO: 121 - protein, 560 aa, Unknown
  Synthetic Construct
MSDSCSCPSAPTIFMLLQMKRAKTSDETFNPVYPYDTENGPPSVPFLTPPFVSPDGFQESPPGVLSLRLSEPLVTSHGMLALKMGNGLSLDDAGNLTSQDVTTVTPPLKKTKTNLSLQTSAPLTVSSGSLTVAAAAPLAVAGTSLTMQSQAPLTVQDAKLSLATQGPLTVSEGKLTLQTSAPLTAADSSTLTVGTTPPISVSSGSLGLDMEDPMYTHDGKLGIRIGGPLQVVDSLHTLTVVTGNGITVANNALQTKVAGALGYDSSGNLELRAAGGMRINTGGQLILDVAYPFDAQNNLSLRLGQGPLYVNTNHNLDLNCNRGLTTTTSSNTTKLETKIDSGLDYNANGAIIAKLGTGLTFDNTGAITVGNTGDDKLTLWTTPDPSPNCRIHADKDCKFTLVLTKCGSQILASVAALAVSGNLSSMTGTVSSVTIFLRFDQNGVLMENSSLDKEYWNFRNGNSTNATPYTNAVGFMPNLSAYPKTQSQTAKNNIVSEVYLHGDKSKPMILTITLNGTNESSETSQVSHYSMSFTWSWDSGKYATETFATNSFTFSYIAEQ

SEQ ID NO: 122 - DNA, 960 bp, Unknown
  Simian adenovirus 44
  CDS (6)..(546): E1a
  CDS (656)..(951): E1a
gaaaaatgagacatttcacctacgatggcggtctgctcaccggccagctggctgcctcggtcctggacgtcctgatcgaggaggtattggccgacaattatcctcctccagctcattttgagccgcctactcttcacgaactgtatgatttggacgtggtggcacctagcgacccgaacgagcaggcggtttccagtttttttcctgactctatgctgttggccagccaggagggggtcgagctggagacccctcctccaattctcgtttcccctgagccgccgaccctgaccaggcagcccgatcgccgtgttggacctgcgactatgccccatctgctgcccgaggtgatcgatctcacctgtaacgagtctggttttccacccagcgaggatgaggacgaagagggtgagcagtttgtgttagattctgtggaggaacccgggcgcggttgcagatcttgtcaataccatcggaaaaatacaggagacccccaaattatgtgttccctgtgttatatgaagacgacctgtatgtttatttacagtaagtttgtgattggtgggtcggtgggctgtagtgtgggtaggtggtctgtggtttttttttttaatatcagcttgggctaaaaaactgctatggtaattttttaaaggtccggtgtctgaacctgagcaggaagctgaaccggagcctgagagtcgccccaggagaaggcctgcaattctaactagaccgagtgcacctgtagcgagggacctcagcagtgcagagaccaccgattccggtccttcctcatcccctccagagattcaccccgtggtgcctttgtgtcccctcaagcccgttgccgtgagagttagtgggcggagggccgccgtggagagcattgaggacttgcttaatgagacacaggaacctttggacttgagttgtaaacgccctaggcaataaacctgc

SEQ ID NO: 123 - protein, 279 aa, Unknown
  Synthetic Construct
MRHFTYDGGLLTGQLAASVLDVLIEEVLADNYPPPAHFEPPTLHELYDLDVVAPSDPNEQAVSSFFPDSMLLASQEGVELETPPPILVSPEPPTLTRQPDRRVGPATMPHLLPEVIDLTCNESGFPPSEDEDEEGEQFVLDSVEEPGRGCRSCQYHRKNTGDPQIMCSLCYMKTTCMFIYSPVSEPEQEAEPEPESRPRRRPAILTRPSAPVARDLSSAETTDSGPSSSPPEIHPVVPLCPLKPVAVRVSGRRAAVESIEDLLNETQEPLDLSCKRPRQ

SEQ ID NO: 124 - DNA, 950 bp, Unknown
  Simian adenovirus 44
  CDS (9)..(339): 33K
  CDS (557)..(945): 33K
ttcccaggatggcacccagaaagaagcagccgccgccgccgccagcatacatgcttctggaggaagaggaggactgggacagtcaggcagaggaggtttcggacgaggacgaggaggaggagatgatggaagactgggaggaggacagcctagacgaggaagcttcagaggccgaagaggtggcagacgcaacaccatcaccctcggccgcagccccctcgccggcgcccccgaaatcctccgaccccagcagcagcgctataacctccgctcctccggcgccggcgcccacccgcagcagacccaaccgtagatgggacactacaggaaccggggtcggtaagtctaagtgccccccagcgccgcccccgcaacaggagcaacagcagcagcagcggcgacagggctaccgctcgtggcgcggacacaagaacgccatagtcgcctgcttgcaagactgcgggggcaacatctccttcgcccgccgcttcctgctcttccaccacggtgtggcttttccccgcaatgtcctgcattactaccgtcatctctacagcccctactgcggcggcagcggcgacccagagggagcggcggcagcagcagcgccagccacagcggcgaccacctaggaagacctccgcgggcaagacggcgggagccgggagacccgcggcggcggcggcagcggcggcagcgggcgcactgcgcctctcgcccaacgaacccctctcgacccgggagctcagacacaggatcttccccactctgtatgctatcttccagcagagcagaggccaggaacaggagctgaaaataaaaaacagatctctgcgctccctcacccgcagctgtctgtatcacaaaagcgaagatcagcttcggcgcacgctggaggacgcggaggcactcttcagcaaatactgcgcgctgactcttaaggactagcc

SEQ ID NO: 125 - protein, 240 aa, Unknown
  Synthetic Construct
MAPRKKQPPPPPAYMLLEEEEDWDSQAEEVSDEDEEEEMMEDWEEDSLDEEASEAEEVADATPSPSAAAPSPAPPKSSDPSSSAITSAPPAPAPTRSRPNRRWDTTGTGVAPTAAAAATQRERRQQQRQPQRRPPRKTSAGKTAGAGRPAAAAAAAAAGALRLSPNEPLSTRELRHRIFPTLYAIFQQSRGQEQELKIKNRSLRSLTRSCLYHKSEDQLRRTLEDAEALFSKYCALTLKD

SEQ ID NO: 126 - DNA, 23 bp, Artificial Sequence
  primer
caggatgcttcggagtacctgag

SEQ ID NO: 127 - DNA, 26 bp, Artificial Sequence
  primer
  misc_feature (6)..(6): n is a, c, g, or t
ttggcnggdatdgggtavagcatgtt

SEQ ID NO: 128 - DNA, 58 bp, Artificial Sequence
  oligomer pSR6 top
aattttaattaacccgggtatcggcgcgccttaacctagggatagatatcttaattaa

SEQ ID NO: 129 - DNA, 56 bp, Artificial Sequence
  oligomer pSR6 bot
tattaattaagatatctatccctaggttaaggcgcgccgatacccgggttaattaa

SEQ ID NO: 130 - DNA, 70 bp, Artificial Sequence
  oligomer P6 top
aattgtttaaactacgtaattaggccggccgcgcacgcgtgtcattaattaagctagatatcgtttaaac

SEQ ID NO: 131 - DNA, 68 bp, Artificial Sequence
  oligomer P6 bot
gtttaaacgatatctagcttaattaatgacacgcgtgcgcggccggcctaattacgtagtttaaacat

SEQ ID NO: 132 - DNA, 38 bp, Artificial Sequence
  oligmoer 951top
cgcgcatatggatcgatcgctagcgatcgatcgaattc

SEQ ID NO: 133 - DNA, 38 bp, Artificial Sequence
  oligomer 951bot
cgcggaattcgatcgatcgctagcgatcgatccatatg

SEQ ID NO: 134 - DNA, 27 bp, Artificial Sequence
  oligomer 42.1
catcatcaataatataccttattttgg

SEQ ID NO: 135 - DNA, 33 bp, Artificial Sequence
  oligomer 42.2
cccagattacgtataaaacggagactttgaccc

SEQ ID NO: 136 - DNA, 463 bp, Artificial Sequence
  fragment of SAdV-42.2 genomic DNA, plus 10 bp overhang
catcatcaataatataccttattttggattgaagccaatatgataatgaggtgggcggagcggggcggagttgggaggcgcggggcggggcggcggcgcggggcgggccgggaggtgtggcggaagttgagtttgtaagtgtggcggatgagacttgctagcgccggatgtggtaaaagtgacgtttttggagtgcgacaacgcccacgggaagtgacatttttcccgcggtttttaccggatgtcgtagtgaatttgggcgttaccaagtaagatttggccattttcgcgggaaaactgaaatggggaagtgaaatctgattaatttcgcgttagtcataccgcgtaatatttgccgagggccgagggactttgaccgattacgtggaggaatcgcccaggtgttttttgaggtgaatttccgcgttccgggtcaaagtctccgttttatacgtaatctggg

SEQ ID NO: 137 - DNA, 33 bp, Artificial Sequence
  oligomer 42.3
cgttttatacgtaatctgggcaacaggaggggt

SEQ ID NO: 138 - DNA, 20 bp, Artificial Sequence
  oligomer 42.4
tcggtcacatccagcatcac

SEQ ID NO: 139 - DNA, 242 bp, Artificial Sequence
  fragment of SAdV-42.2 and SnaBI site
cgttttatacgtaatctgggcaacaggaggggtgtgttcctgccctatcaatgcaacttgagccacaccaaggtcttgctagagcccgaaagcatgtccaaggtgaacctgaacggggtgtttgacatgaccctgaagatatggaaggtgctgaggtacgacgagaccaggtctcggtgcaggccctgcgagtgcgggggcaagcatatgaggaaccagcctgtgatgctggatgtgaccga

SEQ ID NO: 140 - DNA, 44 bp, Artificial Sequence
  reverse primer
gatcacgcgtcatgcatgcatatgaatacactccgcgtcagctg

SEQ ID NO: 141 - protein, 9 aa, Unknown
  immunodominant peptide of influenza nucleoprotein
TYQRTRALV

The invention claimed is:

1. A recombinant adenovirus having a capsid comprising:
   (a) a hexon protein of Simian Adenovirus 42.1 (SAdV-42.1), amino acids 1 to 957 of SEQ ID NO:43; a penton protein of SAdV-42.1, amino acids 1 to 581 of SEQ ID NO:38; and a fiber protein of SAdV-42.1, amino acids 1 to 577 of SEQ ID NO:52;
   (b) a hexon protein of SAdV-42.2, amino acids 1 to 957 of SEQ ID NO:74; a penton protein of SAdV-42.2, amino acids 1 to 586 of SEQ ID NO:69; and a fiber protein of SAdV-42.2, amino acids 1 to 595 of SEQ ID NO:83; or
   (c) a hexon protein of SAdV-44, amino acids 1 to 962 of SEQ ID NO:105; a penton protein of SAdV-44, amino acids 1 to 581 of SEQ ID NO:100; and a fiber protein of SAdV-44, amino acids 1 to 560 of SEQ ID NO:121;

IIIa, SEQ ID NO: 37;
VII, SEQ ID NO: 39;
V, SEQ ID NO: 40;
pX, SEQ ID NO: 41;
VI, SEQ ID NO: 42;
Endoprotease, SEQ ID NO: 44;
100 kD, SEQ ID NO: 45;
33 kD, SEQ ID NO: 63;
22 kD, SEQ ID NO: 56;
VIII, SEQ ID NO: 46;
12.5 K, SEQ ID NO: 57;
CR1-alpha, SEQ ID NO: 47;
gp19K, SEQ ID NO: 48;
CR1-beta, SEQ ID NO: 49;

CR1-gamma, SEQ ID NO: 58;
RID-alpha, SEQ ID NO: 50;
RID-beta, SEQ ID NO: 51; and
E3/14.7K, SEQ ID NO: 59; and 121.

11. A method for targeting a cell having an adenoviral receptor comprising delivering to a subject a composition according to claim 10.

12. A composition comprising a recombinant adenovirus according to claim 1 in a pharmaceutically acceptable carrier.

13. A method for targeting a cell having an adenoviral receptor comprising delivering to a subject a recombinant adenovirus according to claim 1.

14. A composition comprising a recombinant adenovirus according to claim 1 comprising the hexon, penton, and fiber capsid proteins of SAdV-42.2, wherein said recombinant adenovirus further comprises one or more simian adenovirus proteins selected from the group consisting of:
E1a, SEQ ID NO: 92;
E1b, small T/19K, SEQ ID NO: 65;
E1b, large T/55K, SEQ ID NO: 85;
IX, SEQ ID NO: 66;
52/55D, SEQ ID NO: 67;
IIIa, SEQ ID NO: 68;
VII, SEQ ID NO: 70;
V, SEQ ID NO: 71;
pX, SEQ ID NO: 72;
VI, SEQ ID NO: 73;
Endoprotease, SEQ ID NO: 75;
100 kD, SEQ ID NO: 76;
33 kD, SEQ ID NO: 94;
22 kD, SEQ ID NO: 87;
VIII, SEQ ID NO: 77;
12.5 K, SEQ ID NO: 78;
CR1-alpha, SEQ ID NO: 88;
gp19K, SEQ ID NO: 79;
CR1-beta, SEQ ID NO: 80;
CR1-gamma, SEQ ID NO: 89;
RID-alpha, SEQ ID NO: 81;
RID-beta, SEQ ID NO: 82; and
E3/14.7K, SEQ ID NO: 90.

15. A method for targeting a cell having an adenoviral receptor comprising delivering to a subject a composition according to claim 14.

16. A composition comprising a recombinant adenovirus according to claim 1 comprising the hexon, penton, and fiber capsid proteins of SAdV-44, wherein said recombinant adenovirus further comprises one or more simian adenovirus proteins selected from the group consisting of:
E1a, SEQ ID NO: 123;
E1b, small T/19K, SEQ ID NO: 96;
E1b, large T/55K, SEQ ID NO: 116;
IX, SEQ ID NO: 97;
52/55D, SEQ ID NO: 98;
IIIa, SEQ ID NO: 99;
VII, SEQ ID NO: 101;
V, SEQ ID NO: 102;
pX, SEQ ID NO: 103;
VI, SEQ ID NO: 104;
Endoprotease, SEQ ID NO: 106;
100 kD, SEQ ID NO: 107;
33 kD, SEQ ID NO: 125;
22 kD, SEQ ID NO: 118;
VIII, SEQ ID NO: 108;
12.5 K, SEQ ID NO: 109;
CR1-alpha, SEQ ID NO: 110;
gp19K, SEQ ID NO: 111;
CR1-beta, SEQ ID NO: 112;
CR1-gamma, SEQ ID NO: 119;
RID-alpha, SEQ ID NO: 113;
RID-beta, SEQ ID NO: 114; and
E3/14.7K, SEQ ID NO: 120.

17. A method for targeting a cell having an adenoviral receptor comprising delivering to a subject a composition according to claim 16.

* * * * *

UNITED STATES PATENT AND TRADEMARK OFFICE
CERTIFICATE OF CORRECTION

PATENT NO. : 8,470,310 B2  
APPLICATION NO. : 12/920648  
DATED : June 25, 2013  
INVENTOR(S) : Soumitra Roy et al.

Page 1 of 1

It is certified that error appears in the above-identified patent and that said Letters Patent is hereby corrected as shown below:

In the Claims

Claim 10, last line (column 41, line 4), replace "E3/14.7K, SEQ ID NO: 59; and 121." with
-- E3/14.7K, SEQ ID NO: 59. --

Signed and Sealed this
Twentieth Day of August, 2013

Teresa Stanek Rea
*Acting Director of the United States Patent and Trademark Office*